(12) United States Patent
Sajadi et al.

(10) Patent No.: US 12,331,105 B2
(45) Date of Patent: Jun. 17, 2025

(54) BROADLY NEUTRALIZING ANTIBODIES AGAINST HIV

(71) Applicants: University of Maryland, Baltimore, Baltimore, MD (US); The United States Government as Represented by the Department of Veterans Affairs, Washington, DC (US); Dongkyoon Kim, Palo Alto, CA (US); Guy Cavet, Hillsborough, CA (US)

(72) Inventors: Mohammad Sajadi, Cockeysville, MD (US); George K. Lewis, Baltimore, MD (US); Anthony DeVico, Alexandria, VA (US); Dongkyoon Kim, Palo Alto, CA (US); Guy Cavet, Hillsborough, CA (US)

(73) Assignees: University of Maryland, Baltimore, Baltimore, MD (US); The United States Government as Represented by the Department of Veterans Affairs, Washington, DC (US)

(*) Notice: Subject to any disclaimer, the term of this patent is extended or adjusted under 35 U.S.C. 154(b) by 0 days.

(21) Appl. No.: 17/677,757

(22) Filed: Feb. 22, 2022

(65) Prior Publication Data
US 2023/0002480 A1 Jan. 5, 2023

Related U.S. Application Data

(63) Continuation of application No. 16/626,163, filed as application No. PCT/US2018/039162 on Jun. 22, 2018, now abandoned.

(60) Provisional application No. 62/673,607, filed on May 18, 2018, provisional application No. 62/591,244, filed on Nov. 28, 2017, provisional application No. 62/589,614, filed on Nov. 22, 2017, provisional application No. 62/573,764, filed on Oct. 18, 2017, provisional application No. 62/523,437, filed on Jun. 22, 2017.

(51) Int. Cl.
| | | |
|---|---|---|
| C07K 16/10 | (2006.01) | |
| A61K 39/42 | (2006.01) | |
| A61K 45/06 | (2006.01) | |
| A61P 31/18 | (2006.01) | |

(52) U.S. Cl.
CPC .......... *C07K 16/1063* (2013.01); *A61K 39/42* (2013.01); *A61K 45/06* (2013.01); *A61P 31/18* (2018.01); *C07K 16/1045* (2013.01); *C07K 2317/34* (2013.01); *C07K 2317/565* (2013.01); *C07K 2317/732* (2013.01); *C07K 2317/76* (2013.01); *C07K 2317/92* (2013.01); *C07K 2317/94* (2013.01)

(58) Field of Classification Search
None
See application file for complete search history.

(56) References Cited

U.S. PATENT DOCUMENTS

| | | | |
|---|---|---|---|
| 5,237,053 A | 8/1993 | Dorner | |
| 5,464,759 A | 11/1995 | Coolidge | |
| 6,180,370 B1 * | 1/2001 | Queen | A61P 19/02 435/69.6 |
| 7,378,093 B2 | 5/2008 | Dimitrov | |
| 9,115,399 B2 | 8/2015 | Panigrahi | |
| 9,146,241 B2 | 9/2015 | Lavinder | |
| 9,493,549 B2 | 12/2016 | Diskin | |
| 9,695,230 B2 * | 7/2017 | Kwong | C07K 16/1063 |
| 2011/0223615 A1 | 9/2011 | Lewis | |
| 2013/0251726 A1 | 9/2013 | Mascola | |
| 2014/0328862 A1 | 11/2014 | Scheid | |
| 2015/0011405 A1 | 1/2015 | DeFalco et al. | |
| 2016/0034639 A1 | 2/2016 | Reddy et al. | |
| 2016/0289305 A1 | 10/2016 | Mascola et al. | |
| 2020/0172601 A1 | 6/2020 | Sajadi | |
| 2020/0182883 A1 | 6/2020 | Sajadi | |
| 2020/0239551 A1 | 7/2020 | Sajadi | |
| 2021/0040184 A1 | 2/2021 | Cavet et al. | |

FOREIGN PATENT DOCUMENTS

| | | | |
|---|---|---|---|
| WO | 1994018232 A1 | 8/1994 | |
| WO | 2005030123 A2 | 4/2005 | |
| WO | 2005077106 A3 | 8/2005 | |
| WO | 2009046984 A1 | 4/2009 | |
| WO | 2012148497 A2 | 11/2012 | |
| WO | WO-2013016468 A2 * | 1/2013 | A61P 31/18 |
| WO | 2013078455 A2 | 5/2013 | |
| WO | 2013090644 A2 | 6/2013 | |
| WO | 2013185180 A1 | 12/2013 | |
| WO | 2016154003 A1 | 9/2016 | |
| WO | 2017205694 A1 | 11/2017 | |
| WO | 2018237357 A1 | 12/2018 | |

(Continued)

OTHER PUBLICATIONS

Sajadi, Mohammad M., et al. "Signature biochemical properties of broadly cross-reactive HIV-1 neutralizing antibodies in human plasma." Journal of virology 86.9 (2012): 5014-5025.. (Year: 2012).*
Sajadi, Mohammad Mohseni, et al. "Identification of near-pan-neutralizing antibodies against HIV-1 by deconvolution of plasma humoral responses." Cell 173.7 (2018): 1783-1795.. (Year: 2018).*
Kipriyanov, Sergey M., and Fabrice Le Gall. "Generation and production of engineered antibodies." Molecular biotechnology 26.1 (2004): 39-60. (Year: 2004).*

(Continued)

*Primary Examiner* — Michael Szperka
*Assistant Examiner* — Lia E Taylor
(74) *Attorney, Agent, or Firm* — Nevrivy Patent Law Group P.L.L.C.

(57) ABSTRACT

The present invention provides broadly neutralizing antibodies against HIV, compositions comprising the same and methods of use thereof.

37 Claims, 51 Drawing Sheets

Specification includes a Sequence Listing.

(56) References Cited

FOREIGN PATENT DOCUMENTS

| WO | 2019067805 A1 | 4/2019 | |
|---|---|---|---|
| WO | 2019165122 A1 | 8/2019 | |
| WO | 2019173794 A1 | 9/2019 | |
| WO | 2019173801 A1 | 9/2019 | |
| WO | WO-2019173802 A1 * | 9/2019 | ......... C07K 16/1045 |

OTHER PUBLICATIONS

Janeway, A. C., et al. "Immunobiology: the immune system in health and disease. London." Current Biology (1997): 3:1-3:11. (Year: 1997).*
International Search Report from Appl. No. PCT/US2018/039162, mailed on Oct. 2, 2018.
Shcherbakov et al., Broadly Neutralizing Antibodies against HIV-1 as a Novel Aspect of the Immune Response, Acta Naturae, (2015), vol. 7, p. 11-21.
Sajadi et al., Signature Biochemical Properties of Broadly Cross-Reactive HIV-1 Neutralizing Antibodies in Human Plasma, J Virol., (2012), vol. 86, p. 5014-5025.
Eroshkin et al., bNAber: database of broadly neutralizing HIV antibodies, Nucleic Acids Research, (2014), vol. 42, p. D1133-D1139.
UnitProtKB_A0A0K2DDS5, Methyltransferase. Entry Name: A0A0K2DDS5_9RHIZ. Accession No. A0A0K2DDS5. last modified: Nov. 11, 2015. Retrieved on Sep. 5, 2018. URL: https://www.uniprot.org/uniprot/A0A0K2DDS5> Protein; Accession Number; and Sequence, 392 (a.a.), the region between amino acid residues 172-184.
UnitProtKB_S0KM22, 6-phospho-beta-glucosidase. Entry Name: S0KM22_9ENTE. Accession Number. S0KM22. Last modified: Sep. 18, 2013. Retrieved on Sep. 5, 2018. URL https://www.uniprot.org/uniprot/S0KM22> Protein; Accession Number; and Sequence, 480 (a.a.), the region between 451-471.
UnitProtKB_A0A151HET4, Uncharacterized protein. Entry Name: A0A151HET4_TOXGO. Accession Number. A0A151HET4. Last modified: Jun. 8, 2016. Retrieved on Sep. 5, 2018. URL: https://www.uniprot.org/uniprot/A0A151HET4> Protein; Accession Number, and Sequence, 3571 (a.a.), the region between amino acid residues 3036-3053.
UnitProtKB_N1JM12. Uncharacterized protein. Entry Name: N1JM12_BLUG1. Accession No. N1JM12. Last Modified: Jun. 26, 2013. Retrieved on Sep. 5, 2018. URL: https//www.uniprot.org/uniprot/N1JM12> Protein; Accession Number; and Sequence, 2011 (a.a.), the region between amino acid residues 690-706.
Sok et al., HIV Broadly Neutralizing Antibodies: Taking Good care of the 98%, Immunity, (2016), vol. 45, p. 958-960.
European Extended Search Report from Appl. No. EP17803634, mailed on Dec. 18, 2019.
Sato et al., Proteomics-directed cloning of circulating antiviral human monoclanal antibodies, Nature Biotechnology, vol. 30, (2012), p. 1039-1043.
Wine et al., Molecular deconvolution of the monoclonal antibodies that comprise the polyclonal serum response, Proceedings of the National Academy of Sciences, vol. 110 (2013), p. 2993-2998.
Cheung et al., A proteomics approach for the identification and cloning of monoclonal antibodies form serum, Nature Biotechnology, (2012), p. 1087-0156.
Wang et al., Antigen identification and characterization of lung cancer specific monoclonal antibodies produced by mAb proteomics, Journal of Proteome Research, American Chemical Society, vol. 9, (2010), p. 1834-1842.
Extended European Search Report from Appl. No. EP 18820469.7, mailed on May 21, 2021.
Montezuma-Rusca, Bone Marrow Plasma Cells Are a Primary Source of Serum HIV-1-Specific Antibodies in Chronically Infected Individuals, Jimmunol, (2015), p. 1-12.
Sajadi et al., Correlation between circulating HIV-1 RNA and broad HIV-1 neutralizing antibody activity, J Acquir Immune Defic Syndr, (2011) p. 57:9-15.
Sajadi et al., λ Light Chain Bias Associated With Enhanced Binding and Function of Anti-HIV Env Glycoprotein Antibodies, J Infect Dis, (2016) 213:156-164.
Robinson, Sequencing the functional antibody repertoire—diagnostic and therapeutic discovery, Nat Rev Rheumatol, (2015), 11(3):171-182.
Bashford-Rogers et al., Capturing needles in haystacks: a comparison of B-cell receptor sequencing methods, BMC Immunology, (2014), p. 15(29): 1-9.
Kumar et al., CD45 expression by bone marrow plasma cells in multiple myeloma: clinical and biological correlations, Leukemia, (2005)19:1466-1470.
Huang et al., Identification of a CD4-Binding-Site Antibody to HIV that Evolved Near-Pan Neutralization Breadth, Immunity, (2016), 45:1108-1121.
Huang et al., Broad and potent neutralization of HIV-1 by a gp41-specific human antibody, nature, (2012), 491:406-412.
Sajadi et al., Identification of Near-Pan-neutralizing Antibodies against HIV-1 by Deconvolution of Plasma Humoral Responses, Cell, (2018) 173: 1783-1795.
Dashti et al., Broadly Neutralizing Antibodies against HIV: Back to Blood, Trends in Molecular Medicine, (2019), 25:228-240.
Supplementary Partial European Search Report from Appl. No. EP 18820469.7, mailed on Feb. 9, 2021.
Supplementary European Search Report from Appl. No. 19764362, mailed on Nov. 5, 2021.
Scheepers et al., Serum glycan-binding IgG antibodies in HIV-1 infection and during the development of broadly neutralizing responses, AIDS, (2017), 31:2199-2209.
Supplemental information, Identification of Neal-Pan-neutralizing Antibodies againts HIV-1 by deconvolution of Plasma Humoral Responses, Cell. (2018), p. 1-7, XP55855060.
Sajadi, *Homo sapiens* isolate N49P7 anti-HIV immunoglobulin heavy chain variable region (IGHV) mRNA, partial cds, (2018), XP055855065.
Sajadi, *Homo sapiens* isolate N49P7 anti-HIV immunoglobulin light chain variable region (IGLV) mRNA, partial cds, (2018), XP055855069.
Huang Jinghe et al., Identification of a CD4-Binding-Site Antibody to HIV that Evolved Near-Pan Neutralization Breadth, Immunity, (2016) 45:1108-1121, XP029809256.
Huang Jinghe et al. Broad and potent neutralization of HIV-1 by a gp41-specific human antibody, Nature, (2012) 491:406-412, XP055134187.
Tomoyuki Igawa et al., Engineering the variable region of therapeutic IgG antibodies, MABS, (2011), 3:243-252, XP055532826.
International Search Report from Appl. No. PCT/US19/21495, mailed on Aug. 6, 2019.
International Search Report from Appl. No. PCT/US19/21493, mailed on Aug. 12, 2019.
International Search Report from Appl. No. PCT/US19/21486, mailed on Aug. 12, 2019.
Office Action from Appl. No. U.S. Appl. No. 16/626,163, mailed on Aug. 31, 2021.
Office Action from Appl. No. U.S. Appl. No. 16/725,596 mailed on Apr. 29, 2021.
Office Action from Appl. No. U.S. Appl. No. 16/725,596 mailed on Feb. 17, 2022.

* cited by examiner

A.

B.

FIG. 2 (Continuation)
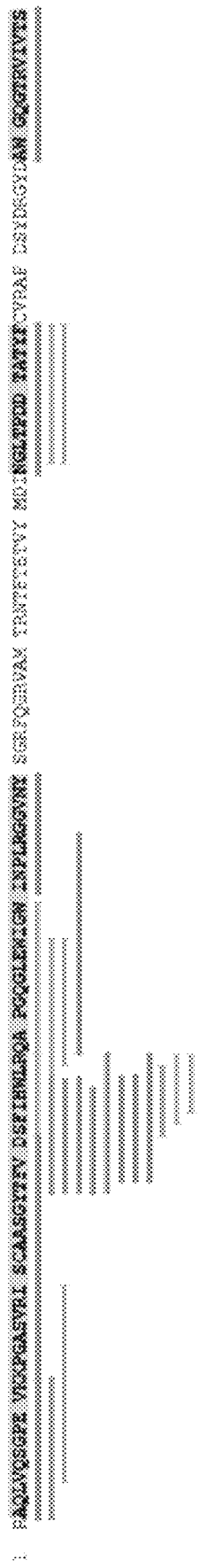

N49P7.1 (Chi² 1.41 KD=1.143E-9)

N49P7.1 D368R

N49P9 gp120 (Chi² 1.24; KD=2.45E-8)

Global Protein alignment. Reference molecule: N49P6 light cha, Region 1 to 99
Sequences: 3. Scoring matrix: BLOSUM 62

Sequence View: Similarity Format. Color areas of high matches at same base position N49P6 light cha1    1  qsalsqpasvsanpggsvrtiscigtsnyraxcqqpgqapkllyainxrpagrscrgtsgtsgntaaitieglqaddegyfcwafeniggtklivl
N49P63 light cha    1  qsalsqpasvsaspggsvrtiscigtsnyrswaqqkpnxqqkapkllyafnkrpsgredfsgtsgnaaitilsglqaddegyfcwafeniggtklivl
N49P6A light cha    1  qsalsqpasvsanpggsvrtiscigtsnyrsvaqqkpgqapkllyafnkrpgyrodfsgrsgnaaitieglqaddegyfcwafeniggtklivl

Global Protein alignment. Reference molecule: N4997 Light, Region 1 to 99
Sequences: 3. Scoring matrix: BLOSUM 62

Sequence view: Similarity Format. Color areas of high matches at same base position N4997 Light    1  qsaltqprsvsaspgqsvtiscrgtshlvswyqqhpgkapkliyadtnkrpsvpdrfsgsksgtsasltitglqaeddaeyfcaayeafggtkltvl
N4997S         1  qsaltqprsvsaspgqsvtiscrgtnlvswyqqhpgkapkliyadtnkrpsvpdrfsgsksgtsasltitglqaeddaeyfcaayeafggtkltvl
N4997A         1  qsaltqprsvsaspgqsvtiscrgtnlvswaqhpgkapkliyadtnkrpsgpdrfsgsksgtsasltitglqaeddaeyfcaayeafggtkltvl

FIG. 18C

FIG. 21 (Continuation)
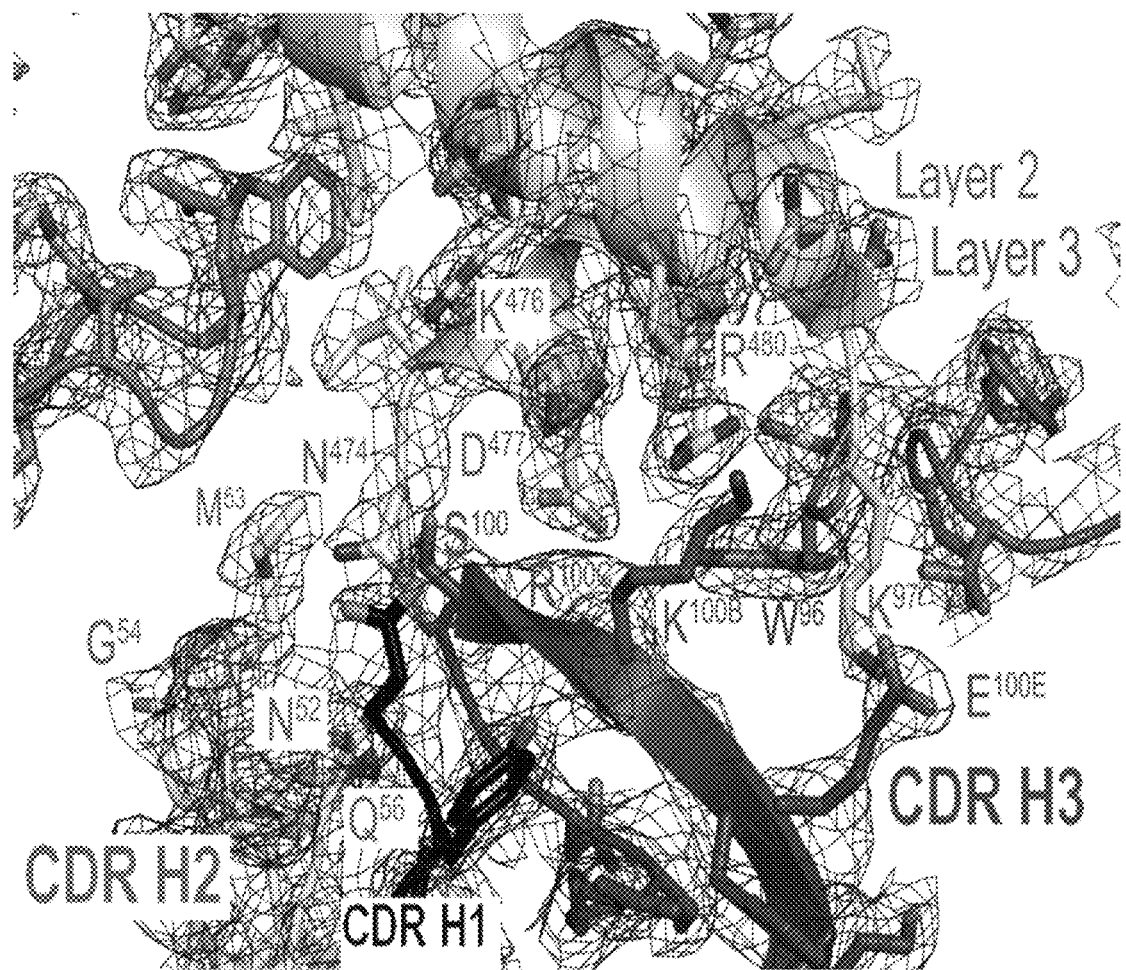

BROADLY NEUTRALIZING ANTIBODIES AGAINST HIV

CROSS-REFERENCE TO RELATED APPLICATIONS

This application claims the benefit of U.S. Provisional Appl. No. 62/523,437, filed Jun. 22, 2017, U.S. Provisional Appl. No. 62/573,764, filed Oct. 18, 2017, U.S. Provisional Appl. No. 62/589,614, filed Nov. 22, 2017, U.S. Provisional Appl. No. 62/591,244, filed Nov. 28, 2017, and U.S. Provisional Appl. No. 62/673,607, filed May 18, 2018, the contents of which are hereby incorporated by reference in their entirety.

STATEMENT OF FEDERALLY SPONSORED RESEARCH AND DEVELOPMENT

This invention was made with government support under Grant Number AI110259 awarded by the National Institutes of Health and under Grant Number 1I01BX002358 awarded by the United States Department of Veterans Affairs. The government has certain rights in the invention.

INCORPORATION-BY-REFERENCE OF MATERIAL SUBMITTED ELECTRONICALLY

Incorporated by reference in its entirety herein is a computer-readable sequence listing submitted concurrently herewith and identified as follows: One 884,569 Byte ASCII (Text) file named "Sequence_Listing_ST25.txt," created on Jun. 22, 2018.

FIELD OF THE INVENTION

The field of the invention relates to medicine, infectious disease and in particular antibodies which can neutralize HIV-1 virus strains.

BACKGROUND OF THE INVENTION

HIV is an integrating retrovirus that rapidly establishes chronic infection in CD4+ T cells. This fundamental characteristic means that prevention of HIV infection largely depends on humoral responses and associated effector mechanisms directed against the HIV envelope proteins (gp120 and gp41) that drive viral attachment and entry.

Humoral anti-envelope responses in a minority of HIV-infected persons comprise neutralizing activity against diverse viral variants (Scheid et al., *Nature* 458, 636-640 (2009); Simek et al., *J Virol* 83, 7337-7348 (2009); Walker et al., *PLoS Pathog* 6, e1001028 (2010); Sajadi et al., *J Acquir Immune Defic Syndr* 57, 9-15 (2011); Sajadi et al., *J Infect Dis* 213, 156-164 (2016)). Broadly neutralizing responses can be used to guide the development of effective HIV vaccines and/or other immune-based prevention measures. Three types of information are essential to implementing this concept. First, conserved sites of extreme neutralization sensitivity within the HIV envelope structure must be defined. Significant steps in this direction have been afforded by the derivation of broadly neutralizing monoclonal anti-envelope antibodies (mAbs) from the memory B cell pools of certain HIV-infected individuals. These antibodies reveal a number of especially potent neutralizing epitopes on gp120, including the CD4 binding site (CD4-BS), V1V2 glycan, V3 glycan, and the gp41 membrane-proximal external region (Haynes et al., *J Allergy Clin Immunol* 134, 3-10; quiz 11 (2014). Second, the features of broadly neutralizing antibodies that arise in multiple individuals, versus rare subjects, must be fully characterized. A number of serological studies have made progress in this regard, particularly with respect to epitopes on gp120 (Scheid et al., *Nature* 458, 636-640 (2009); Simek et al., *J Virol* 83, 7337-7348 (2009); Walker et al., *PLoS Pathog* 6, e1001028 (2010); Sajadi et al., *J Acquir Immune Defic Syndr* 57, 9-15 (2011); Sajadi et al., *J Virol* 86, 5014-5025 (2012)). Third, the aggregate nature of the polyclonal humoral environment in which broadly neutralizing activities evolve, persist and function must be understood. Collectively, this information can be used to delineate whether and how certain epitope presentation patterns should be avoided or targeted in order to deliberately achieve potent and broad neutralizing activity.

To date, the interrelationships between broadly neutralizing antibodies and the circulating plasma anti-HIV envelope humoral repertoires that harbor them have been examined mainly by indirect means. Typical approaches involve protein fractionation, antigen depletion and/or infectivity analyses using viral envelopes with targeted mutations (Sather et al., *Vaccine* 28 Suppl 2, B8-12 (2010); Li et al., *J Virol* 83, 1045-1059 (2009); Dhillon et al., *J Virol* 81, 6548-6562 (2007)). These methods do not fully elucidate the background milieu of the polyclonal anti-envelope humoral response and cannot clearly define the neutralizing antibody species in circulation. For example, various studies indicate that broad plasma neutralizing activity may be traced to either pauciclonal or polyclonal antibody species (Scheid et al., *Nature* 458, 636-640 (2009); Walker et al., *PLoS Pathog* 6, e1001028 (2010); Sajadi et al., *J Virol* 86, 5014-5025 (2012); Bonsignori et al., *J Virol* 86, 4688-4692 (2012); Doria-Rose et al., *J Virol* 84, 1631-1636 (2010)). depending on the source subject. Alternatively, intensive efforts have been applied toward the derivation of neutralizing mAbs from memory B cell pools. These antibodies, albeit important for other purposes, may not reflect the true nature of neutralizing antibodies in circulation (Guan et al., *Proc Natl Acad Sci USA* 106, 3952-3957 (2009); Scheid et al., *Nature* 458, 636-640 (2009); Walker et al., *Science* 326, 285-289 (2009); Walker et al., *Nature* 477, 466-470 (2011).

There is a need to develop new therapies for treatment and prevention of HIV infection in patients.

This background information is provided for informational purposes only. No admission is necessarily intended, nor should it be construed, that any of the preceding information constitutes prior art against the present invention.

SUMMARY OF THE INVENTION

It is to be understood that both the foregoing general description of the embodiments and the following detailed description are exemplary, and thus do not restrict the scope of the embodiments.

In one aspect, the invention provides an isolated anti-HIV antibody, wherein the antibody is capable of neutralizing at least 95% of the HIV viruses listed in Table 1 with an IC50 value of less than 50 µg/mL. In some embodiments, the isolated anti-HIV antibody is capable of neutralizing at least 99% of the HIV pseudoviruses listed in Table 1 with an IC50 value of less than 50 µg/mL. In some embodiments, the antibody is capable of neutralizing 100% of the HIV pseudoviruses listed in Table 1 with an IC50 value of less than 50 µg/mL. In some embodiments, the antibody is selected from the group consisting of
} a. N49P6 or an antigen binding fragment thereof;
b. N49P7 or an antigen binding fragment thereof;
c. N49P7.1 or an antigen binding fragment thereof; and
d. N49P11 or an antigen binding fragment thereof.

In another aspect, the invention provides an isolated anti-HIV antibody, wherein the antibody is capable of neutralizing 100% of the HIV clade B, G and D pseudoviruses listed in Table 1 with an IC50 value of less than 50 μg/mL. In some embodiments, the antibody is selected from the group consisting of
a. N49P6 or an antigen binding fragment thereof;
b. N49P7 or an antigen binding fragment thereof;
c. N49P7.1 or an antigen binding fragment thereof;
d. N49P11 or an antigen binding fragment thereof; and
e. N49P9 or an antigen binding fragment thereof.

In another aspect, the invention provides an isolated anti-HIV antibody, wherein the antibody is capable of neutralizing HIV pseudoviruses listed in Table 1 with a median IC50 value of less than 0.5 μg/mL. In some embodiments, the antibody is selected from the group consisting of
a. N49P6 or an antigen binding fragment thereof;
b. N49P7 or an antigen binding fragment thereof;
c. N49P7.1 or an antigen binding fragment thereof
d. N49P9 or an antigen binding fragment thereof; and
e. N49P23 or an antigen binding fragment thereof.

In another aspect, the invention provides an isolated anti-HIV antibody selected from the group consisting of:
a. an antibody comprising a heavy chain amino acid sequence comprising SEQ ID NO:1 or an antigen binding fragment thereof and a light chain amino acid sequence comprising SEQ ID NO:2 or an antigen binding fragment thereof;
b. an antibody comprising a heavy chain amino acid sequence comprising SEQ ID NO:3 or an antigen binding fragment thereof and a light chain amino acid sequence comprising SEQ ID NO:4 or an antigen binding fragment thereof;
c. an antibody comprising a heavy chain amino acid sequence comprising SEQ ID NO:5 or an antigen binding fragment thereof and a light chain amino acid sequence comprising SEQ ID NO:6 or an antigen binding fragment thereof;
d. an antibody comprising a heavy chain amino acid sequence comprising SEQ ID NO:7 or an antigen binding fragment thereof and a light chain amino acid sequence comprising SEQ ID NO:8 or an antigen binding fragment thereof;
e. an antibody comprising a heavy chain amino acid sequence comprising SEQ ID NO:9 or an antigen binding fragment thereof and a light chain amino acid sequence comprising SEQ ID NO:10 or an antigen binding fragment thereof;
f. an antibody comprising a heavy chain amino acid sequence comprising SEQ ID NO:11 or an antigen binding fragment thereof and a light chain amino acid sequence comprising SEQ ID NO:12 or an antigen binding fragment thereof;
g. an antibody comprising a heavy chain amino acid sequence comprising SEQ ID NO:13 or an antigen binding fragment thereof and a light chain amino acid sequence comprising SEQ ID NO:14 or an antigen binding fragment thereof;
h. an antibody comprising a heavy chain amino acid sequence comprising SEQ ID NO:15 or an antigen binding fragment thereof and a light chain amino acid sequence comprising SEQ ID NO:16 or an antigen binding fragment thereof;
i. an antibody comprising a heavy chain amino acid sequence comprising SEQ ID NO:17 or an antigen binding fragment thereof and a light chain amino acid sequence comprising SEQ ID NO:18 or an antigen binding fragment thereof;
j. an antibody comprising a heavy chain amino acid sequence comprising SEQ ID NO:19 or an antigen binding fragment thereof and a light chain amino acid sequence comprising SEQ ID NO:20 or an antigen binding fragment thereof;
k. an antibody comprising a heavy chain amino acid sequence comprising SEQ ID NO:21 or an antigen binding fragment thereof and a light chain amino acid sequence comprising SEQ ID NO:22 or an antigen binding fragment thereof;
l. an antibody comprising a heavy chain amino acid sequence comprising SEQ ID NO:23 or an antigen binding fragment thereof and a light chain amino acid sequence comprising SEQ ID NO:24 or an antigen binding fragment thereof;
m. an antibody comprising a heavy chain amino acid sequence comprising SEQ ID NO:25 or an antigen binding fragment thereof and a light chain amino acid sequence comprising SEQ ID NO:26 or an antigen binding fragment thereof;
n. an antibody comprising a heavy chain amino acid sequence comprising SEQ ID NO:27 or an antigen binding fragment thereof and a light chain amino acid sequence comprising SEQ ID NO:28 or an antigen binding fragment thereof;
o. an antibody comprising a heavy chain amino acid sequence comprising SEQ ID NO:29 or an antigen binding fragment thereof and a light chain amino acid sequence comprising SEQ ID NO:30 or an antigen binding fragment thereof;
p. an antibody comprising a heavy chain amino acid sequence comprising SEQ ID NO:31 or an antigen binding fragment thereof and a light chain amino acid sequence comprising SEQ ID NO:32 or an antigen binding fragment thereof;
q. an antibody comprising a heavy chain amino acid sequence comprising SEQ ID NO:33 or an antigen binding fragment thereof and a light chain amino acid sequence comprising SEQ ID NO:34 or an antigen binding fragment thereof;
r. an antibody comprising a heavy chain amino acid sequence comprising SEQ ID NO:35 or an antigen binding fragment thereof and a light chain amino acid sequence comprising SEQ ID NO:36 or an antigen binding fragment thereof;
s. an antibody comprising a heavy chain amino acid sequence comprising SEQ ID NO:37 or an antigen binding fragment thereof and a light chain amino acid sequence comprising SEQ ID NO:38 or an antigen binding fragment thereof;
t. an antibody comprising a heavy chain amino acid sequence comprising SEQ ID NO:39 or an antigen binding fragment thereof and a light chain amino acid sequence comprising SEQ ID NO:40 or an antigen binding fragment thereof;
u. an antibody comprising a heavy chain amino acid sequence comprising SEQ ID NO:41 or an antigen binding fragment thereof and a light chain amino acid sequence comprising SEQ ID NO:42 or an antigen binding fragment thereof;
v. an antibody comprising a heavy chain amino acid sequence comprising SEQ ID NO:43 or an antigen binding fragment thereof and a light chain amino acid sequence comprising SEQ ID NO:44 or an antigen binding fragment thereof;
w. an antibody comprising a heavy chain amino acid sequence comprising SEQ ID NO:45 or an antigen binding fragment thereof and a light chain amino acid sequence comprising SEQ ID NO:46 or an antigen binding fragment thereof;
x. an antibody comprising a heavy chain amino acid sequence comprising SEQ ID NO:47 or an antigen binding fragment thereof and a light chain amino acid sequence comprising SEQ ID NO:48 or an antigen binding fragment thereof;
y. an antibody comprising a heavy chain amino acid sequence comprising SEQ ID NO:49 or an antigen binding fragment thereof and a light chain amino acid sequence comprising SEQ ID NO:50 or an antigen binding fragment thereof;
z. an antibody comprising a heavy chain amino acid sequence comprising SEQ ID NO:51 or an antigen binding fragment thereof and a light chain amino acid sequence comprising SEQ ID NO:52 or an antigen binding fragment thereof;
aa. an antibody comprising a heavy chain amino acid sequence comprising SEQ ID NO:53 or an antigen binding fragment thereof and a light chain amino acid sequence comprising SEQ ID NO:54 or an antigen binding fragment thereof;
bb. an antibody comprising a heavy chain amino acid sequence comprising SEQ ID NO:55 or an antigen binding fragment thereof and a light chain amino acid sequence comprising SEQ ID NO:56 or an antigen binding fragment thereof;
cc. an antibody comprising a heavy chain amino acid sequence comprising SEQ ID NO:57 or an antigen binding fragment thereof and a light chain amino acid sequence comprising SEQ ID NO:58 or an antigen binding fragment thereof;
dd. an antibody comprising a heavy chain amino acid sequence comprising SEQ ID NO:59 or an antigen binding fragment thereof and a light chain amino acid sequence comprising SEQ ID NO:60 or an antigen binding fragment thereof;
ee. an antibody comprising a heavy chain amino acid sequence comprising SEQ ID NO:61 or an antigen binding fragment thereof and a light chain amino acid sequence comprising SEQ ID NO:62 or an antigen binding fragment thereof;
ff. an antibody comprising a heavy chain amino acid sequence comprising SEQ ID NO:63 or an antigen binding fragment thereof and a light chain amino acid sequence comprising SEQ ID NO:64 or an antigen binding fragment thereof;
gg. an antibody comprising a heavy chain amino acid sequence comprising SEQ ID NO:65 or an antigen binding fragment thereof and a light chain amino acid sequence comprising SEQ ID NO:66 or an antigen binding fragment thereof;
hh. an antibody comprising a heavy chain amino acid sequence comprising SEQ ID NO:67 or an antigen binding fragment thereof and a light chain amino acid sequence comprising SEQ ID NO:68 or an antigen binding fragment thereof;
ii. an antibody comprising a heavy chain amino acid sequence comprising SEQ ID NO:69 or an antigen binding fragment thereof and a light chain amino acid sequence comprising SEQ ID NO:70 or an antigen binding fragment thereof;
jj. an antibody comprising a heavy chain amino acid sequence comprising SEQ ID NO:71 or an antigen binding fragment thereof and a light chain amino acid sequence comprising SEQ ID NO:72 or an antigen binding fragment thereof;
kk. an antibody comprising a heavy chain amino acid sequence comprising SEQ ID NO:73 or an antigen binding fragment thereof and a light chain amino acid sequence comprising SEQ ID NO:74 or an antigen binding fragment thereof; and
ll. an antibody comprising a heavy chain amino acid sequence comprising SEQ ID NO:75 or an antigen binding fragment thereof and a light chain amino acid sequence comprising SEQ ID NO:76 or an antigen binding fragment thereof.

In another aspect, the invention provides an isolated anti-HIV antibody selected from the group consisting of:
a. an antibody comprising a heavy chain amino acid sequence comprising SEQ ID NO:153 or an antigen binding fragment thereof and a light chain amino acid sequence comprising SEQ ID NO:155 or an antigen binding fragment thereof;
b. an antibody comprising a heavy chain amino acid sequence comprising SEQ ID NO:157 or an antigen binding fragment thereof and a light chain amino acid sequence comprising SEQ ID NO:159 or an antigen binding fragment thereof;
c. an antibody comprising a heavy chain amino acid sequence comprising SEQ ID NO:161 or an antigen binding fragment thereof and a light chain amino acid sequence comprising SEQ ID NO:163 or an antigen binding fragment thereof;
d. an antibody comprising a heavy chain amino acid sequence comprising SEQ ID NO:165 or an antigen binding fragment thereof and a light chain amino acid sequence comprising SEQ ID NO:167 or an antigen binding fragment thereof;
e. an antibody comprising a heavy chain amino acid sequence comprising SEQ ID NO:169 or an antigen binding fragment thereof and a light chain amino acid sequence comprising SEQ ID NO:171 or an antigen binding fragment thereof;
f. an antibody comprising a heavy chain amino acid sequence comprising SEQ ID NO:173 or an antigen binding fragment thereof and a light chain amino acid sequence comprising SEQ ID NO:175 or an antigen binding fragment thereof;
g. an antibody comprising a heavy chain amino acid sequence comprising SEQ ID NO:177 or an antigen binding fragment thereof and a light chain amino acid sequence comprising SEQ ID NO:179 or an antigen binding fragment thereof;
h. an antibody comprising a heavy chain amino acid sequence comprising SEQ ID NO:181 or an antigen binding fragment thereof and a light chain amino acid sequence comprising SEQ ID NO:183 or an antigen binding fragment thereof;
i. an antibody comprising a heavy chain amino acid sequence comprising SEQ ID NO:185 or an antigen binding fragment thereof and a light chain amino acid sequence comprising SEQ ID NO:187 or an antigen binding fragment thereof;
j. an antibody comprising a heavy chain amino acid sequence comprising SEQ ID NO:189 or an antigen binding fragment thereof and a light chain amino acid sequence comprising SEQ ID NO:191 or an antigen binding fragment thereof;
k. an antibody comprising a heavy chain amino acid sequence comprising SEQ ID NO:193 or an antigen binding fragment thereof and a light chain amino acid sequence comprising SEQ ID NO:195 or an antigen binding fragment thereof;
l. an antibody comprising a heavy chain amino acid sequence comprising SEQ ID NO:197 or an antigen binding fragment thereof and a light chain amino acid sequence comprising SEQ ID NO:199 or an antigen binding fragment thereof;
m. an antibody comprising a heavy chain amino acid sequence comprising SEQ ID NO:201 or an antigen binding fragment thereof and a light chain amino acid sequence comprising SEQ ID NO:203 or an antigen binding fragment thereof;
n. an antibody comprising a heavy chain amino acid sequence comprising SEQ ID NO:205 or an antigen binding fragment thereof and a light chain amino acid sequence comprising SEQ ID NO:207 or an antigen binding fragment thereof;
o. an antibody comprising a heavy chain amino acid sequence comprising SEQ ID NO:209 or an antigen binding fragment thereof and a light chain amino acid sequence comprising SEQ ID NO:211 or an antigen binding fragment thereof;
p. an antibody comprising a heavy chain amino acid sequence comprising SEQ ID NO:213 or an antigen binding fragment thereof and a light chain amino acid sequence comprising SEQ ID NO:215 or an antigen binding fragment thereof;
q. an antibody comprising a heavy chain amino acid sequence comprising SEQ ID NO:217 or an antigen binding fragment thereof and a light chain amino acid sequence comprising SEQ ID NO:219 or an antigen binding fragment thereof;
r. an antibody comprising a heavy chain amino acid sequence comprising SEQ ID NO:221 or an antigen binding fragment thereof and a light chain amino acid sequence comprising SEQ ID NO:223 or an antigen binding fragment thereof;
s. an antibody comprising a heavy chain amino acid sequence comprising SEQ ID NO:225 or an antigen binding fragment thereof and a light chain amino acid sequence comprising SEQ ID NO:227 or an antigen binding fragment thereof;
t. an antibody comprising a heavy chain amino acid sequence comprising SEQ ID NO:229 or an antigen binding fragment thereof and a light chain amino acid sequence comprising SEQ ID NO:231 or an antigen binding fragment thereof;
u. an antibody comprising a heavy chain amino acid sequence comprising SEQ ID NO:233 or an antigen binding fragment thereof and a light chain amino acid sequence comprising SEQ ID NO:235 or an antigen binding fragment thereof;
v. an antibody comprising a heavy chain amino acid sequence comprising SEQ ID NO:237 or an antigen binding fragment thereof and a light chain amino acid sequence comprising SEQ ID NO:239 or an antigen binding fragment thereof;
w. an antibody comprising a heavy chain amino acid sequence comprising SEQ ID NO:241 or an antigen binding fragment thereof and a light chain amino acid sequence comprising SEQ ID NO:243 or an antigen binding fragment thereof;
x. an antibody comprising a heavy chain amino acid sequence comprising SEQ ID NO:245 or an antigen binding fragment thereof and a light chain amino acid sequence comprising SEQ ID NO:247 or an antigen binding fragment thereof;
y. an antibody comprising a heavy chain amino acid sequence comprising SEQ ID NO:249 or an antigen binding fragment thereof and a light chain amino acid sequence comprising SEQ ID NO:251 or an antigen binding fragment thereof;
z. an antibody comprising a heavy chain amino acid sequence comprising SEQ ID NO:253 or an antigen binding fragment thereof and a light chain amino acid sequence comprising SEQ ID NO:255 or an antigen binding fragment thereof;
aa. an antibody comprising a heavy chain amino acid sequence comprising SEQ ID NO:257 or an antigen binding fragment thereof and a light chain amino acid sequence comprising SEQ ID NO:259 or an antigen binding fragment thereof;
bb. an antibody comprising a heavy chain amino acid sequence comprising SEQ ID NO:261 or an antigen binding fragment thereof and a light chain amino acid sequence comprising SEQ ID NO:263 or an antigen binding fragment thereof;
cc. an antibody comprising a heavy chain amino acid sequence comprising SEQ ID NO:265 or an antigen binding fragment thereof and a light chain amino acid sequence comprising SEQ ID NO:267 or an antigen binding fragment thereof;
dd. an antibody comprising a heavy chain amino acid sequence comprising SEQ ID NO:269 or an antigen binding fragment thereof and a light chain amino acid sequence comprising SEQ ID NO:271 or an antigen binding fragment thereof;
ee. an antibody comprising a heavy chain amino acid sequence comprising SEQ ID NO:273 or an antigen binding fragment thereof and a light chain amino acid sequence comprising SEQ ID NO:275 or an antigen binding fragment thereof;
ff. an antibody comprising a heavy chain amino acid sequence comprising SEQ ID NO:277 or an antigen binding fragment thereof and a light chain amino acid sequence comprising SEQ ID NO:279 or an antigen binding fragment thereof;
gg. an antibody comprising a heavy chain amino acid sequence comprising SEQ ID NO:281 or an antigen binding fragment thereof and a light chain amino acid sequence comprising SEQ ID NO:283 or an antigen binding fragment thereof;
hh. an antibody comprising a heavy chain amino acid sequence comprising SEQ ID NO:285 or an antigen binding fragment thereof and a light chain amino acid sequence comprising SEQ ID NO:287 or an antigen binding fragment thereof;
ii. an antibody comprising a heavy chain amino acid sequence comprising SEQ ID NO:289 or an antigen binding fragment thereof and a light chain amino acid sequence comprising SEQ ID NO:291 or an antigen binding fragment thereof;
jj. an antibody comprising a heavy chain amino acid sequence comprising SEQ ID NO:293 or an antigen binding fragment thereof and a light chain amino acid sequence comprising SEQ ID NO:295 or an antigen binding fragment thereof;

kk. an antibody comprising a heavy chain amino acid sequence comprising SEQ ID NO:297 or an antigen binding fragment thereof and a light chain amino acid sequence comprising SEQ ID NO:299 or an antigen binding fragment thereof;

ll. an antibody comprising a heavy chain amino acid sequence comprising SEQ ID NO:301 or an antigen binding fragment thereof and a light chain amino acid sequence comprising SEQ ID NO:303 or an antigen binding fragment thereof;

mm. an antibody comprising a heavy chain amino acid sequence comprising SEQ ID NO:305 or an antigen binding fragment thereof and a light chain amino acid sequence comprising SEQ ID NO:307 or an antigen binding fragment thereof;

nn. an antibody comprising a heavy chain amino acid sequence comprising SEQ ID NO:309 or an antigen binding fragment thereof and a light chain amino acid sequence comprising SEQ ID NO:311 or an antigen binding fragment thereof;

oo. an antibody comprising a heavy chain amino acid sequence comprising SEQ ID NO:313 or an antigen binding fragment thereof and a light chain amino acid sequence comprising SEQ ID NO:315 or an antigen binding fragment thereof;

pp. an antibody comprising a heavy chain amino acid sequence comprising SEQ ID NO:317 or an antigen binding fragment thereof and a light chain amino acid sequence comprising SEQ ID NO:319 or an antigen binding fragment thereof;

qq. an antibody comprising a heavy chain amino acid sequence comprising SEQ ID NO:321 or an antigen binding fragment thereof and a light chain amino acid sequence comprising SEQ ID NO:323 or an antigen binding fragment thereof;

rr. an antibody comprising a heavy chain amino acid sequence comprising SEQ ID NO:325 or an antigen binding fragment thereof and a light chain amino acid sequence comprising SEQ ID NO:327 or an antigen binding fragment thereof;

ss. an antibody comprising a heavy chain amino acid sequence comprising SEQ ID NO:329 or an antigen binding fragment thereof and a light chain amino acid sequence comprising SEQ ID NO:331 or an antigen binding fragment thereof;

tt. an antibody comprising a heavy chain amino acid sequence comprising SEQ ID NO:333 or an antigen binding fragment thereof and a light chain amino acid sequence comprising SEQ ID NO:335 or an antigen binding fragment thereof;

uu. an antibody comprising a heavy chain amino acid sequence comprising SEQ ID NO:337 or an antigen binding fragment thereof and a light chain amino acid sequence comprising SEQ ID NO:339 or an antigen binding fragment thereof;

vv. an antibody comprising a heavy chain amino acid sequence comprising SEQ ID NO:341 or an antigen binding fragment thereof and a light chain amino acid sequence comprising SEQ ID NO:343 or an antigen binding fragment thereof;

ww. an antibody comprising a heavy chain amino acid sequence comprising SEQ ID NO:345 or an antigen binding fragment thereof and a light chain amino acid sequence comprising SEQ ID NO:347 or an antigen binding fragment thereof;

xx. an antibody comprising a heavy chain amino acid sequence comprising SEQ ID NO:349 or an antigen binding fragment thereof and a light chain amino acid sequence comprising SEQ ID NO:351 or an antigen binding fragment thereof;

yy. an antibody comprising a heavy chain amino acid sequence comprising SEQ ID NO:353 or an antigen binding fragment thereof and a light chain amino acid sequence comprising SEQ ID NO:355 or an antigen binding fragment thereof;

zz. an antibody comprising a heavy chain amino acid sequence comprising SEQ ID NO:357 or an antigen binding fragment thereof and a light chain amino acid sequence comprising SEQ ID NO:359 or an antigen binding fragment thereof;

aaa. an antibody comprising a heavy chain amino acid sequence comprising SEQ ID NO:361 or an antigen binding fragment thereof and a light chain amino acid sequence comprising SEQ ID NO:363 or an antigen binding fragment thereof;

bbb. an antibody comprising a heavy chain amino acid sequence comprising SEQ ID NO:365 or an antigen binding fragment thereof and a light chain amino acid sequence comprising SEQ ID NO:367 or an antigen binding fragment thereof;

ccc. an antibody comprising a heavy chain amino acid sequence comprising SEQ ID NO:369 or an antigen binding fragment thereof and a light chain amino acid sequence comprising SEQ ID NO:371 or an antigen binding fragment thereof;

ddd. an antibody comprising a heavy chain amino acid sequence comprising SEQ ID NO:373 or an antigen binding fragment thereof and a light chain amino acid sequence comprising SEQ ID NO:375 or an antigen binding fragment thereof;

eee. an antibody comprising a heavy chain amino acid sequence comprising SEQ ID NO:377 or an antigen binding fragment thereof and a light chain amino acid sequence comprising SEQ ID NO:379 or an antigen binding fragment thereof;

fff. an antibody comprising a heavy chain amino acid sequence comprising SEQ ID NO:381 or an antigen binding fragment thereof and a light chain amino acid sequence comprising SEQ ID NO:383 or an antigen binding fragment thereof;

ggg. an antibody comprising a heavy chain amino acid sequence comprising SEQ ID NO:385 or an antigen binding fragment thereof and a light chain amino acid sequence comprising SEQ ID NO:387 or an antigen binding fragment thereof;

hhh. an antibody comprising a heavy chain amino acid sequence comprising SEQ ID NO:389 or an antigen binding fragment thereof and a light chain amino acid sequence comprising SEQ ID NO:391 or an antigen binding fragment thereof;

iii. an antibody comprising a heavy chain amino acid sequence comprising SEQ ID NO:393 or an antigen binding fragment thereof and a light chain amino acid sequence comprising SEQ ID NO:395 or an antigen binding fragment thereof; and jjj. an antibody comprising a heavy chain amino acid sequence comprising SEQ ID NO:397 or an antigen binding fragment thereof and a light chain amino acid sequence comprising SEQ ID NO:399 or an antigen binding fragment thereof.

In another aspect, the invention provides an anti-HIV antibody selected from the group consisting of:
a. an antibody comprising a heavy chain variable region, wherein CDR H1 comprises GYDFIDYV (SEQ ID NO:401), CDR H2 comprises MNPSGGGT (SEQ ID NO:402) and CDR H3 comprises VRDRANGSGRRR-FESVNWFLDL (SEQ ID NO:403); and a light chain variable region, wherein CDR L1 comprises HNY, CDR L2 comprises DFN and CDR L3 comprises WAFEN (SEQ ID NO:404);
b. an antibody comprising a heavy chain variable region, wherein CDR H1 comprises GYKFPDYI (SEQ ID NO:405), CDR H2 comprises INPMGGQV (SEQ ID NO:406) and CDR H3 comprises VRDRSNGSGRR-FESSN (SEQ ID NO:407); and a light chain variable region, wherein CDR L1 comprises HNL, CDR L2 comprises DFN and CDR L3 comprises WAYEA (SEQ ID NO:408);
c. an antibody comprising a heavy chain variable region, wherein CDR H1 comprises GYTFTDYL (SEQ ID NO:409), CDR H2 comprises MNPVYGQV (SEQ ID NO:410) and CDR H3 comprises VRDTGDGSR-RHFDSINWFLDL (SEQ ID NO:411); and a light chain variable region, wherein CDR L1 comprises HNY, CDR L2 comprises DFD and CDR L3 comprises WAFEA (SEQ ID NO:412);
d. an antibody comprising a heavy chain variable region, wherein CDR H1 comprises GYTFTDYV (SEQ ID NO:413), CDR H2 comprises IDPPYGQV (SEQ ID NO:414) and CDR H3 comprises VRDRSNGWGKR-FESSNWFLDL (SEQ ID NO:415); and a light chain variable region, wherein CDR L1 comprises HNL, CDR L2 comprises DFN and CDR L3 comprises WAYEA (SEQ ID NO:408);
e. an antibody comprising a heavy chain variable region, wherein CDR H1 comprises GYTFVDYF (SEQ ID NO:416), CDR H2 comprises MDPLNGRP (SEQ ID NO:417) and CDR H3 comprises VRDKSNGS-GRRFDSSNWFLDL (SEQ ID NO:418); and a light chain variable region, wherein CDR L1 comprises HNY, CDR L2 comprises DFN and CDR L3 comprises WAYDA (SEQ ID NO:419);
f. an antibody comprising a heavy chain variable region, wherein CDR H1 comprises GYTFSDYI (SEQ ID NO:420), CDR H2 comprises MNPMGGQV (SEQ ID NO:421) and CDR H3 comprises VRDRSNGSGKR-FESSNWFLDL (SEQ ID NO:441); and a light chain variable region, wherein CDR L1 comprises HNL, CDR L2 comprises DFN and CDR L3 comprises WAYEV (SEQ ID NO:422);
g. an antibody comprising a heavy chain variable region, wherein CDR H1 comprises GYTFIDYI (SEQ ID NO:423), CDR H2 comprises IDPMNGRP (SEQ ID NO:424) and CDR H3 comprises VRDKSNGSGKRFDSSNWFLDL (SEQ ID NO:425); and a light chain variable region, wherein CDR L1 comprises HNY, CDR L2 comprises DFN and CDR L3 comprises WAYDA (SEQ ID NO:419);
h. an antibody comprising a heavy chain variable region, wherein CDR H1 comprises GYTFTDYI (SEQ ID NO:426), CDR H2 comprises MNPMGGRT (SEQ ID NO:427) and CDR H3 comprises VRDKSNGSGKRFDSSNWFLDL (SEQ ID NO:425); and a light chain variable region, wherein CDR L1 comprises HNL, CDR L2 comprises DFN and CDR L3 comprises WAYEA (SEQ ID NO:408);
i. an antibody comprising a heavy chain variable region, wherein CDR H1 comprises GYTFVDYL (SEQ ID NO:428), CDR H2 comprises MDPMNGRP (SEQ ID NO:429) and CDR H3 comprises VRDKSGGSGKLFDSSNWFLDL (SEQ ID NO:430); and a light chain variable region, wherein CDR L1 comprises HNY, CDR L2 comprises DFN and CDR L3 comprises WAYDA (SEQ ID NO:419);
j. an antibody comprising a heavy chain variable region, wherein CDR H1 comprises GYTFTDYV (SEQ ID NO:413), CDR H2 comprises INPGYGQV (SEQ ID NO:431) and CDR H3 comprises VRDRSNGWGKR-FESSNWFLDL (SEQ ID NO:415); and a light chain variable region, wherein CDR L1 comprises HNL, CDR L2 comprises DFN and CDR L3 comprises WAYEA (SEQ ID NO:408);
k. an antibody comprising a heavy chain variable region, wherein CDR H1 comprises GYTFTDYV (SEQ ID NO:413), CDR H2 comprises MDPSYGQV (SEQ ID NO:432) and CDR H3 comprises VRDRSHGS-GRQFESSNWFLDL (SEQ ID NO:433); and a light chain variable region, wherein CDR L1 comprises HNL, CDR L2 comprises DFN and CDR L3 comprises WAYEA (SEQ ID NO:408);
l. an antibody comprising a heavy chain variable region, wherein CDR H1 comprises GYTFTDYV (SEQ ID NO:413), CDR H2 comprises MDPSFGQM (SEQ ID NO:434) and CDR H3 comprises VRDRSHGS-GRLFESSNWFLDL (SEQ ID NO:435); and a light chain variable region, wherein CDR L1 comprises HNL, CDR L2 comprises DFN and CDR L3 comprises WAYEA (SEQ ID NO:408);
m. an antibody comprising a heavy chain variable region, wherein CDR H1 comprises GYRFTDYV (SEQ ID NO:436), CDR H2 comprises MDPSFGRM (SEQ ID NO:437) and CDR H3 comprises VRDRSHGS-GRLFESSNWFLDL (SEQ ID NO:435); and a light chain variable region, wherein CDR L1 comprises HNL, CDR L2 comprises DFN and CDR L3 comprises WAYEA (SEQ ID NO:408);
n. an antibody comprising a heavy chain variable region, wherein CDR H1 comprises GYTFIDYV (SEQ ID NO:438), CDR H2 comprises MDPTYGRM (SEQ ID NO:439) and CDR H3 comprises VRDRSHGS-GRLFESSNWFLDL (SEQ ID NO:435); and a light chain variable region, wherein CDR L1 comprises HNL, CDR L2 comprises DFN and CDR L3 comprises WAYEA (SEQ ID NO:408);
o. an antibody comprising a heavy chain variable region, wherein CDR H1 comprises GYRFLDYI (SEQ ID NO:440), CDR H2 comprises MNPMGGQV (SEQ ID NO:421) and CDR H3 comprises VRDRSNGSGKR-FESSNWFLDL (SEQ ID NO:441); and a light chain variable region, wherein CDR L1 comprises HNL, CDR L2 comprises DFN and CDR L3 comprises WAYEA (SEQ ID NO:408);
p. an antibody comprising a heavy chain variable region, wherein CDR H1 comprises GYKFMDQL (SEQ ID NO:442), CDR H2 comprises MNPTYGQV (SEQ ID NO:443) and CDR H3 comprises ARGPSGENYPFHY (SEQ ID NO:444); and a light chain variable region, wherein CDR L1 comprises RHII (SEQ ID NO:445), CDR L2 comprises DDD and CDR L3 comprises NTYEF (SEQ ID NO:446);

q. an antibody comprising a heavy chain variable region, wherein CDR H1 comprises GYNFVDSR (SEQ ID NO:447), CDR H2 comprises INPLQGGV (SEQ ID NO:448) and CDR H3 comprises ARGIDGKSYPFHF (SEQ ID NO:449); and a light chain variable region, wherein CDR L1 comprises S, CDR L2 comprises ESS and CDR L3 comprises SILEF (SEQ ID NO:450);

r. an antibody comprising a heavy chain variable region, wherein CDR H1 comprises GYTFTTHHGHF (SEQ ID NO:500), CDR H2 comprises MNPMTGQM (SEQ ID NO:462) and CDR H3 comprises ARGDFGQNYPFHY (SEQ ID NO:463); and a light chain variable region, wherein CDR L1 comprises NRYL (SEQ ID NO:464), CDR L2 comprises DDN and CDR L3 comprises ASYER (SEQ ID NO:465);

s. an antibody comprising a heavy chain variable region, wherein CDR H1 comprises GYNFMDQF (SEQ ID NO:466), CDR H2 comprises MNPIYGQV (SEQ ID NO:467) and CDR H3 comprises ARGPSGENYPFHY (SEQ ID NO:444); and a light chain variable region, wherein CDR L1 comprises RHII (SEQ ID NO:445), CDR L2 comprises DDD and CDR L3 comprises NTYEF (SEQ ID NO:446);

t. an antibody comprising a heavy chain variable region, wherein CDR H1 comprises GYNFVDSR (SEQ ID NO:447), CDR H2 comprises INPLHGGV (SEQ ID NO:468) and CDR H3 comprises ARGIDGKSYPFHF (SEQ ID NO:449); and a light chain variable region, wherein CDR L1 comprises S, CDR L2 comprises ESS and CDR L3 comprises SILEF (SEQ ID NO:450);

u. an antibody comprising a heavy chain variable region, wherein CDR H1 comprises GYTFTKYF (SEQ ID NO:451), CDR H2 comprises IHPRTGAV (SEQ ID NO:452) and CDR H3 comprises ARGAFEADSYGSSYPFHH (SEQ ID NO:453); and a light chain variable region, wherein CDR L1 comprises GNYNP (SEQ ID NO:454), CDR L2 comprises EDN and CDR L3 comprises ASFEF (SEQ ID NO:455);

v. an antibody comprising a heavy chain variable region, wherein CDR H1 comprises GYTFTKYT (SEQ ID NO:456), CDR H2 comprises IHPRTGAV (SEQ ID NO:452) and CDR H3 comprises ARGAFEADLSGPTYPFHH (SEQ ID NO:457); and a light chain variable region, wherein CDR L1 comprises GNYNP (SEQ ID NO:454), CDR L2 comprises EDN and CDR L3 comprises ASFEF (SEQ ID NO:455);

w. an antibody comprising a heavy chain variable region, wherein CDR H1 comprises GFNFIDSV (SEQ ID NO:458), CDR H2 comprises IKPLRGAV (SEQ ID NO:459) and CDR H3 comprises AKGAFRGGSPFGF (SEQ ID NO:460); and a light chain variable region, wherein CDR L1 comprises DVT and CDR L2 comprises ASREF (SEQ ID NO:461);

x. an antibody comprising a heavy chain variable region, wherein CDR H1 comprises GYTFTSYF (SEQ ID NO:469), CDR H2 comprises INPLHGAV (SEQ ID NO:470) and CDR H3 comprises TRGIVADGWPYGH (SEQ ID NO:471); and a light chain variable region, wherein CDR L1 comprises S, CDR L2 comprises EGA and CDR L3 comprises SSLQF (SEQ ID NO:472);

y. an antibody comprising a heavy chain variable region, wherein CDR H1 comprises GFTFIDHI (SEQ ID NO:473), CDR H2 comprises IKPLRGAV (SEQ ID NO:459) and CDR H3 comprises CKAAAPEEAFPLQY (SEQ ID NO:474); and a light chain variable region, wherein CDR L1 comprises NVD, CDR L2 comprises DNN and CDR L3 comprises SSRTF (SEQ ID NO:475);

z. an antibody comprising a heavy chain variable region, wherein CDR H1 comprises GFKFIDHI (SEQ ID NO:476), CDR H2 comprises IKPLGGVA (SEQ ID NO:477) and CDR H3 comprises CKAAAPDEAFPLEY (SEQ ID NO:478); and a light chain variable region, wherein CDR L1 comprises NVD, CDR L2 comprises DNN and CDR L3 comprises SSTTF (SEQ ID NO:479);

aa. an antibody comprising a heavy chain variable region, wherein CDR H1 comprises GFAFLDH (SEQ ID NO:480), CDR H2 comprises VKTIGGVV (SEQ ID NO:481) and CDR H3 comprises SKAAAPDEAFPLEF (SEQ ID NO:482); and a light chain variable region, wherein CDR L1 comprises NVD, CDR L2 comprises DNN and CDR L3 comprises SSTTF (SEQ ID NO:479);

bb. an antibody comprising a heavy chain variable region, wherein CDR H1 comprises GFKFTEYF (SEQ ID NO:483), CDR H2 comprises LNPLRGAV (SEQ ID NO:484) and CDR H3 comprises ARAVFNEAFPFDY (SEQ ID NO:485); and a light chain variable region, wherein CDR L1 comprises VS, CDR L2 comprises DGD and CDR L3 comprises ASREF (SEQ ID NO:461);

cc. an antibody comprising a heavy chain variable region, wherein CDR H1 comprises GFKFIDHI (SEQ ID NO:476), CDR H2 comprises IKPLGGVA (SEQ ID NO:477) and CDR H3 comprises CKAAAPDEAFPLEY (SEQ ID NO:478); and a light chain variable region, wherein CDR L1 comprises NVD, CDR L2 comprises DND and CDR L3 comprises SSTTF (SEQ ID NO:479);

dd. an antibody comprising a heavy chain variable region, wherein CDR H1 comprises GFAFLDHI (SEQ ID NO:486), CDR H2 comprises VKTIGGVV (SEQ ID NO:481) and CDR H3 comprises SKAAAPDEAFPLEF (SEQ ID NO:482); and a light chain variable region, wherein CDR L1 comprises NVD, CDR L2 comprises DNN and CDR L3 comprises SSTTF (SEQ ID NO:479);

ee. an antibody comprising a heavy chain variable region, wherein CDR H1 comprises GFKFIDSV (SEQ ID NO:487), CDR H2 comprises IKPLGGAV (SEQ ID NO:488) and CDR H3 comprises AKGAFGGGSPFGF (SEQ ID NO:489); and a light chain variable region, wherein CDR L1 comprises DVT and CDR L2 comprises ASREF (SEQ ID NO:461);

ff. an antibody comprising a heavy chain variable region, wherein CDR H1 comprises GFNFIDSV (SEQ ID NO:458), CDR H2 comprises IKPLRGGV (SEQ ID NO:490) and CDR H3 comprises AKGAFGGSSPFGF (SEQ ID NO:491); and a light chain variable region, wherein CDR L1 comprises DVT and CDR L2 comprises ASREF (SEQ ID NO:461);

gg. an antibody comprising a heavy chain variable region, wherein CDR H1 comprises GFTFIKYT (SEQ ID NO:492), CDR H2 comprises IHPRTGAV (SEQ ID NO:452) and CDR H3 comprises ARGAFEADLYGPTYPFHH (SEQ ID NO:493); and a light chain variable region, wherein CDR L1 comprises GSYNP (SEQ ID NO:494), CDR L2 comprises DDN and CDR L3 comprises ASFEF (SEQ ID NO:455);

hh. an antibody comprising a heavy chain variable region, wherein CDR H1 comprises GYNFVDSL (SEQ ID NO:495), CDR H2 comprises INPLQGGV (SEQ ID NO:448) and CDR H3 comprises ARGIDGNSYPFHF (SEQ ID NO:496); and a light chain variable region, wherein CDR L1 comprises S, CDR L2 comprises ESS and CDR L3 comprises SILEF (SEQ ID NO:450);

ii. an antibody comprising a heavy chain variable region, wherein CDR H1 comprises GYRFPDYI (SEQ ID NO:497), CDR H2 comprises MNPTYGQV (SEQ ID NO:443) and CDR H3 comprises VRDRSNGSGKR-FESSNWFLDL (SEQ ID NO:441); and a light chain variable region, wherein CDR L1 comprises HNL, CDR L2 comprises DFN and CDR L3 comprises WAYEA (SEQ ID NO:408);

jj. an antibody comprising a heavy chain variable region, wherein CDR H1 comprises GYRFPDYI (SEQ ID NO:497), CDR H2 comprises MNPMGGQV (SEQ ID NO:421) and CDR H3 comprises VRDRSNGSGKR-FESSNWFLDL (SEQ ID NO:441); and a light chain variable region, wherein CDR L1 comprises HNY, CDR L2 comprises DFN and CDR L3 comprises WAFEN (SEQ ID NO:404);

kk. an antibody comprising a heavy chain variable region, wherein CDR H1 comprises GYRFPDYI (SEQ ID NO:497), CDR H2 comprises MNPMGGQV (SEQ ID NO:421) and CDR H3 comprises VRDRSNGSGKR-FESSNWFLDL (SEQ ID NO:441); and a light chain variable region, wherein CDR L1 comprises HNY, CDR L2 comprises DFD and CDR L3 comprises WAFEA (SEQ ID NO:412);

ll. an antibody comprising a heavy chain variable region, wherein CDR H1 comprises GYRFPDYI (SEQ ID NO:497), CDR H2 comprises MNPMGGQV (SEQ ID NO:421) and CDR H3 comprises VRDRSNGSGKR-FESSNWFLDL (SEQ ID NO:441); and a light chain variable region, wherein CDR L1 comprises RHII (SEQ ID NO:445), CDR L2 comprises DDD and CDR L3 comprises NTYEF (SEQ ID NO:446);

mm. an antibody comprising a heavy chain variable region, wherein CDR H1 comprises GYRFPDYI (SEQ ID NO:497), CDR H2 comprises MNPMGGQV (SEQ ID NO:421) and CDR H3 comprises VRDRSNGSGKRFESSNWFLDL (SEQ ID NO:441); and a light chain variable region, wherein CDR L1 comprises HNY, CDR L2 comprises DFN and CDR L3 comprises WAYDA (SEQ ID NO:419);

nn. an antibody comprising a heavy chain variable region, wherein CDR H1 comprises GYRFPDYI (SEQ ID NO:497), CDR H2 comprises MNPMGGQV (SEQ ID NO:421) and CDR H3 comprises VRDRSNGSGKR-FESSNWFLDL (SEQ ID NO:441); and a light chain variable region, wherein CDR L1 comprises HNL, CDR L2 comprises DFN and CDR L3 comprises WAYEA (SEQ ID NO:408);

oo. an antibody comprising a heavy chain variable region, wherein CDR H1 comprises GYKFMDQL (SEQ ID NO:442), CDR H2 comprises MNPTYGQV (SEQ ID NO:443) and CDR H3 comprises VRDRSNGSGKR-FESSN (SEQ ID NO:498); and a light chain variable region, wherein CDR L1 comprises RHII (SEQ ID NO:445), CDR L2 comprises DDD and CDR L3 comprises NTYEF (SEQ ID NO:446);

pp. an antibody comprising a heavy chain variable region, wherein CDR H1 comprises GYKFMDQL (SEQ ID NO:442), CDR H2 comprises MNPTYGQV (SEQ ID NO:443) and CDR H3 comprises VRDRSNGSGKR-FESSNWFLDL (SEQ ID NO:441); and a light chain variable region, wherein CDR L1 comprises RHII (SEQ ID NO:445), CDR L2 comprises DDD and CDR L3 comprises NTYEF (SEQ ID NO:446); and qq. an antibody comprising a heavy chain variable region, wherein CDR H1 comprises GYRFLDYI (SEQ ID NO:440), CDR H2 comprises MNPMGGQV (SEQ ID NO:421) and CDR H3 comprises VRDRSNGSGKR-FESSNWFLDL (SEQ ID NO:441); and a light chain variable region, wherein CDR L1 comprises HNL, CDR L2 comprises DFN and CDR L3 comprises WAYEA (SEQ ID NO:408).

Other objects, features and advantages of the present invention will become apparent from the following detailed description. It should be understood, however, that the detailed description and the specific examples, while indicating specific embodiments of the invention, are given by way of illustration only, since various changes and modifications within the spirit and scope of the invention will become apparent to those skilled in the art from this detailed description.

BRIEF DESCRIPTION OF THE FIGURES

The skilled artisan will understand that the drawings, described below, are for illustration purposes only. The drawings are not intended to limit the scope of the present teachings in any way.

FIG. 11. Heavy and light chain amino acid sequences. For heavy and light chains, V(D)J sequences and $1^{st}$ position of constant region are shown. Homology with germline Heavy 1-2, Lambda 2-11 J2/3, and Lambda 2-23 J2/3 are shown. Nucleotide data is given in a separate excel file (N49 neutralization and sequences).

DETAILED DESCRIPTION OF THE INVENTION

Figure 1:
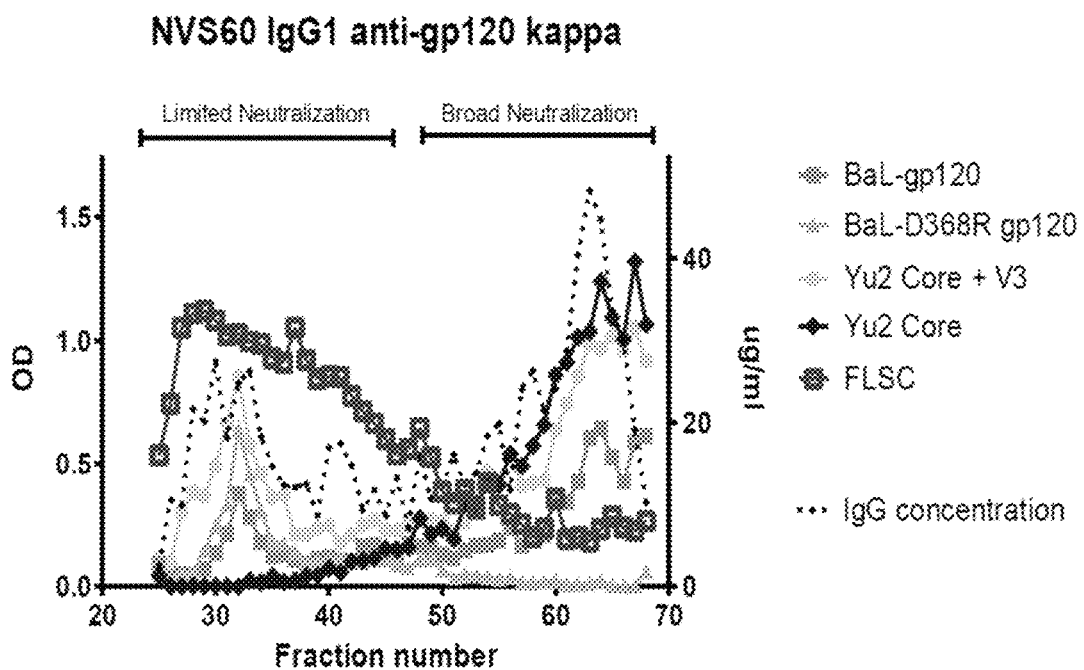
FIG. 1. ELISA reactivity patterns of fractionated IgG from NVS60 with broad HIV neutralizing activity. Anti-gp120 IgG1 kappa (panel A) and lambda (panel B) were fractionated by FFE (see Materials and Methods). Fractions pH ranges from approximately 6.5 (fraction 25) and increasing to 10 (fraction 68) (not shown on the graph). Aliquots (0.05 ug) of IgG from each fraction was tested by ELISA for reactivity against the indicated HIV antigens: (BaL-gp120 monomer, BaL-gp120 monomer with the D368R mutation to abrogate CD4-BS binding, Yu2 gp120 core with V3 loop, and Yu2 gp120 core, and full length single chain (FLSC), presenting a full length CD4-induced gp120 structure in which the CD4 binding site is occupied). The X axis represents the IEF fractions (spanning a pH gradient of 6 to 10 from left to right). The Y axis represents ELISA signals expressed as background-corrected OD450 readings/ug IgG. The right Y axis shows IgG concentration of each fraction (ug/ml). Assays were repeated at least twice. Areas of broad and limited neutralization previously identified based on neutralization (ability to neutralize Tier 2 viruses at <10 ug/ml of affinity purified antibody). Each fraction contains antibodies that can distinguish single epitopes. In panel A, Fractions 55-68 do not bind to D368R envelope mutants but do to the wild-type virus (BaL-gp120). Likewise, Fractions 25-30 and 35-40 in Panel A bind to FLSC (fusion protein between CD4 and gp120) but not monomeric gp120. This strongly suggests antibodies targeting a single epitope (CD4-binding site antibodies and CoReceptor binding site, respectively), as a mixed population of CD4-binding site and non-CD4 binding site antibodies would show some binding to the D368R mutant, and a mixed population of CoReceptor binding site and non-CoReceptor binding site would show binding to the monomer. In Panel B, when the fraction IgG concentrations are compared, the IgG1 anti-gp120 lambda response is almost entirely limited to fractions 28-32, suggesting that one or few antibodies are responsible for the lambda fraction (and by extension up to 60% of the total anti-gp120 response).
Figure 1:
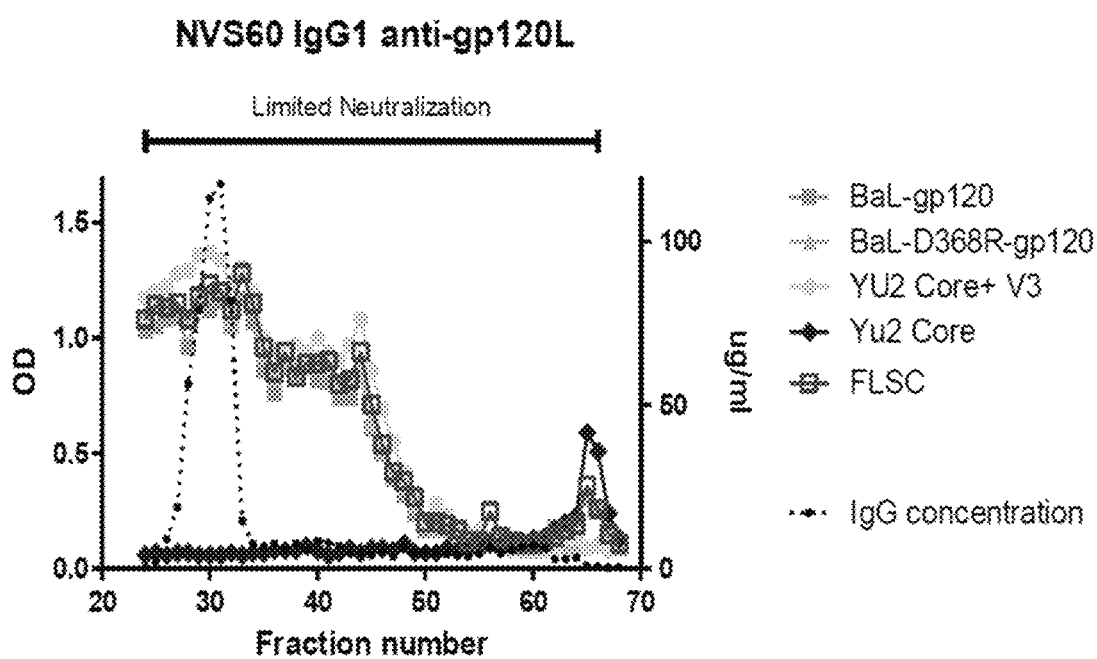

The nature of humoral immunity generated by HIV infection provides critical insights for developing antibody-based prevention measures. While most studies are based on memory B-cell derived antibodies, in this disclosure the circulating polyclonal responses of two HIV-infected subjects with super-neutralizing HIV activity were deconvoluted through purification, fractionation, and direct sequencing of plasma antibodies. These analyses revealed that plasma anti-gp120 responses comprise a limited number of coexistent antibody lineages; only one of which (CD4-binding site) explains the bulk of the neutralizing activity. Members of one lineage (N49P series) comprised of several members, each able to neutralize 100% of isolates tested in a multitier, multiclade 117 pseudovirus panel, including all strains resistant to other broadly neutralizing antibodies. The derivation of such native antibodies with very broad cross-reactivity and potency from the plasma repertoires of multiple individuals should facilitate better understanding of the evolution of HIV humoral immunity, and inform envelope-based immunoprophylaxis strategies.

Reference will now be made in detail to the presently preferred embodiments of the invention which, together with the drawings and the following examples, serve to explain the principles of the invention. These embodiments describe in sufficient detail to enable those skilled in the art to practice the invention, and it is understood that other embodiments may be utilized, and that structural, biological, and chemical changes may be made without departing from the spirit and scope of the present invention. Unless defined otherwise, all technical and scientific terms used herein have the same meanings as commonly understood by one of ordinary skill in the art.

The practice of the present invention employs, unless otherwise indicated, conventional techniques of molecular biology (including recombinant techniques), microbiology, cell biology, biochemistry and immunology, which are within the skill of the art. Such techniques are explained fully in the literature. See, e.g., Sambrook et al. *Molecular Cloning: A Laboratory Manual, 2$^{nd}$ edition* (1989); *Current Protocols in Molecular Biology* (F. M. Ausubel et al. eds. (1987)); the series *Methods in Enzymology* (Academic Press, Inc.); *PCR: A Practical Approach* (M. MacPherson et al. IRL Press at Oxford University Press (1991)); *PCR 2: A Practical Approach* (M. J. MacPherson, B. D. Hames and G. R. Taylor eds. (1995)); *Antibodies, A Laboratory Manual* (Harlow and Lane eds. (1988)); *Using Antibodies, A Laboratory Manual* (Harlow and Lane eds. (1999)); and *Animal Cell Culture* (R. I. Freshney ed. (1987)). Definitions of common terms in molecular biology may be found, for example, in Benjamin Lewin, *Genes VII, published by Oxford University Press*, 2000 (ISBN 019879276X); Kendrew et al. (eds.); *The Encyclopedia of Molecular Biology*, published by Blackwell Publishers, 1994 (ISBN 0632021829); and Robert A. Meyers (ed.), *Molecular Biology and Biotechnology: a Comprehensive Desk Reference*, published by Wiley, John & Sons, Inc., 1995 (ISBN 0471186341).

For the purpose of interpreting this specification, the following definitions will apply and whenever appropriate, terms used in the singular will also include the plural and vice versa. In the event that any definition set forth below conflicts with the usage of that word in any other document, including any document incorporated herein by reference, the definition set forth below shall always control for purposes of interpreting this specification and its associated claims unless a contrary meaning is clearly intended (for example in the document where the term is originally used). The use of "or" means "and/or" unless stated otherwise. As used in the specification and claims, the singular form "a," "an" and "the" include plural references unless the context clearly dictates otherwise. For example, the term "a cell" includes a plurality of cells, including mixtures thereof. The use of "comprise," "comprises," "comprising," "include," "includes," and "including" are interchangeable and not intended to be limiting. Furthermore, where the description of one or more embodiments uses the term "comprising," those skilled in the art would understand that, in some specific instances, the embodiment or embodiments can be alternatively described using the language "consisting essentially of" and/or "consisting of."

Abbreviations for amino acids are used throughout this disclosure and follow the standard nomenclature known in the art. For example, as would be understood by those of ordinary skill in the art, Alanine is Ala or A; Arginine is Arg or R; Asparagine is Asn or N; Aspartic Acid is Asp or D; Cysteine is Cys or C; Glutamic acid is Glu or E; Glutamine is Gln or Q; Glycine is Gly or G; Histidine is His or H; Isoleucine is Ile or I; Leucine is Leu or L; Lysine is Lys or K; Methionine is Met or M; Phenylalanine is Phe or F; Proline is Pro or P; Serine is Ser or S; Threonine is Thr or T; Tryptophan is Trp or W; Tyrosine is Tyr or Y; and Valine is Val or V.

As used herein, the term "about" means plus or minus 10% of the numerical value of the number with which it is being used.

The term "antibody" means an immunoglobulin molecule that recognizes and specifically binds to a target, such as a protein, polypeptide, peptide, carbohydrate, polynucleotide, lipid, or combinations of the foregoing through at least one antigen recognition site within the variable region of the immunoglobulin molecule. As used herein, the term "antibody" encompasses intact polyclonal antibodies, intact monoclonal antibodies, antibody fragments (such as Fab, Fab', F(ab')2, and Fv fragments, dual affinity retargeting antibodies (DART)), single chain Fv (scFv) mutants, multispecific antibodies such as bispecific and trispecific antibodies generated from at least two intact antibodies, chimeric antibodies, humanized antibodies, human antibodies, fusion proteins comprising an antigen determination portion of an antibody, and any other modified immunoglobulin molecule comprising an antigen recognition site so long as the antibodies exhibit the desired biological activity.

In some embodiments, an antibody can be of any the five major classes of immunoglobulins: IgA, IgD, IgE, IgG, and IgM, or subclasses (isotypes) thereof (e.g. IgG1, IgG2, IgG3, IgG4, IgA1 and IgA2), based on the identity of their heavy-chain constant domains referred to as alpha, delta, epsilon, gamma, and mu, respectively. The different classes of immunoglobulins have different and well known subunit structures and three-dimensional configurations. Antibodies can be naked or conjugated to other molecules such as toxins, radioisotopes, etc.

The basic four-chain antibody unit is a heterotetrameric glycoprotein composed of two identical light (L) chains and two identical heavy (H) chains. An IgM antibody consists of 5 basic heterotetramer units along with an additional polypeptide called J chain, and therefore contain 10 antigen binding sites, while secreted IgA antibodies can polymerize to form polyvalent assemblages comprising 2-5 of the basic 4-chain units along with J chain. In the case of IgGs, the 4-chain unit is generally about 150,000 daltons. Each L chain is linked to an H chain by one covalent disulfide bond, while the two H chains are linked to each other by one or more disulfide bonds depending on the H chain isotype. Each H and L chain also has regularly spaced intrachain disulfide bridges. Each H chain has at the N-terminus, a variable region ($V_H$) followed by three constant domains ($C_H$) for each of the α and γ chains and four $C_H$ domains for μ and ε isotypes. Each L chain has at the N-terminus, a variable region ($V_L$) followed by a constant domain ($C_L$) at its other end. The $V_L$ is aligned with the $V_H$ and the $C_L$ is aligned with the first constant domain of the heavy chain ($C_{H1}$). Particular amino acid residues are believed to form an interface between the light chain and heavy chain variable regions. The pairing of a $V_H$ and $V_L$ together forms a single antigen-binding site. For the structure and properties of the different classes of antibodies, see, e.g., Basic and Clinical Immunology, 8th edition, Daniel P. Stites, Abba I. Ten and Tristram G. Parslow (eds.), Appleton & Lange, Norwalk, Conn., 1994, page 71, and Chapter 6.

The L chain from any vertebrate species can be assigned to one of two clearly distinct types, called kappa (κ) and lambda (λ), based on the amino acid sequences of their constant domains ($C_L$). Depending on the amino acid sequence of the constant domain of their heavy chains ($C_H$), immunoglobulins can be assigned to different classes or isotypes. There are five classes of immunoglobulins: IgA, IgD, IgE, IgG, and IgM, having heavy chains designated alpha (α), delta (δ), epsilon (ε), gamma (γ) and mu (μ) respectively. The γ and α classes are further divided into subclasses on the basis of relatively minor differences in $C_H$ sequence and function, e.g., humans express the following subclasses: IgG1, IgG2, IgG3, IgG4, IgA1, and IgA2.

The terms "antigen" or "immunogen" are used interchangeably to refer to a substance, typically a protein, which is capable of inducing an immune response in a subject. The term also refers to proteins that are immunologically active in the sense that once administered to a subject (either directly or by administering to the subject a nucleotide sequence or vector that encodes the protein) is able to evoke an immune response of the humoral and/or cellular type directed against that protein.

The term "antigen binding fragment" or antibody fragment refers to a portion of an intact antibody and comprises the antigenic determining variable regions of an intact antibody. Examples of antigen binding fragment include, but are not limited to Fab, Fab', F(ab')2, and Fv fragments, linear antibodies, single chain antibodies, and multispecific antibodies formed from antibody fragments.

A "monoclonal antibody" refers to a homogeneous antibody population involved in the highly specific recognition and binding of a single antigenic determinant, or epitope. This is in contrast to polyclonal antibodies that typically include different antibodies directed against different antigenic determinants. The term "monoclonal antibody" encompasses both intact and full-length monoclonal antibodies as well as antibody fragments (such as Fab, Fab', F(ab')2, Fv), single chain (scFv) mutants, fusion proteins comprising an antibody portion, and any other modified immunoglobulin molecule comprising an antigen recognition site. Furthermore, "monoclonal antibody" refers to such antibodies made in any number of manners including but not limited to by hybridoma, phage selection, recombinant expression, and transgenic animals.

The term "humanized antibody" refers to forms of non-human (e.g. murine) antibodies that are specific immunoglobulin chains, chimeric immunoglobulins, or fragments thereof that contain minimal non-human (e.g., murine) sequences. Typically, humanized antibodies are human immunoglobulins in which residues from the complementary determining region (CDR) are replaced by residues from the CDR of a non-human species (e.g. mouse, rat, rabbit, hamster) that have the desired specificity, affinity, and capability (Jones et al., 1986, Nature, 321:522-525; Riechmann et al., 1988, Nature, 332:323-327; Verhoeyen et al., 1988, Science, 239:1534-1536). In some instances, the Fv framework region (FR) residues of a human immunoglobulin are replaced with the corresponding residues in an antibody from a non-human species that has the desired specificity, affinity, and capability. The humanized antibody can be further modified by the substitution of additional residues either in the Fv framework region and/or within the replaced non-human residues to refine and optimize antibody specificity, affinity, and/or capability. In general, the humanized antibody will comprise substantially all of at least one, and typically two or three, variable domains containing all or substantially all of the CDR regions that correspond to the non-human immunoglobulin whereas all or substantially all of the FR regions are those of a human immunoglobulin consensus sequence. The humanized antibody can also comprise at least a portion of an immunoglobulin constant region or domain (Fc), typically that of a human immunoglobulin. Examples of methods used to generate humanized antibodies are described in U.S. Pat. No. 5,225,539 or 5,639,641.

A "variable region" of an antibody refers to the variable region of the antibody light chain or the variable region of the antibody heavy chain, either alone or in combination. The variable regions of the heavy and light chain each consist of four framework regions (FR) connected by three complementarity determining regions (CDRs) also known as hypervariable regions. The CDRs in each chain are held together in close proximity by the FRs and, with the CDRs from the other chain, contribute to the formation of the antigen-binding site of antibodies. The term "hypervariable region" when used herein refers to the amino acid residues of an antibody that are responsible for antigen binding. The hypervariable region generally comprises amino acid residues from a "complementarity determining region" or "CDR" (e.g., around about residues 24-34 (L1), 50-56 (L2) and 89-97 (L3) in the $V_L$, and around about 31-35 (H1), 50-65 (H2) and 95-102 (H3) in the $V_H$ when numbered in accordance with the Kabat numbering system; Kabat et al., Sequences of Proteins of Immunological Interest, 5th Ed. Public Health Service, National Institutes of Health, Bethesda, Md. (1991)); and/or those residues from a "hypervariable loop" (e.g., residues 24-34 (L1), 50-56 (L2) and 89-97 (L3) in the $V_L$, and 26-32 (H1), 52-56 (H2) and 95-101 (H3) in the $V_H$ when numbered in accordance with the Chothia numbering system; Chothia and Lesk, J. Mol. Biol. 196:901-917 (1987)); and/or those residues from a "hypervariable loop"/CDR (e.g., residues 27-38 (L1), 56-65 (L2) and 105-120 (L3) in the $V_L$, and 27-38 (H1), 56-65 (H2) and 105-120 (H3) in the $V_H$ when numbered in accordance with the IMGT numbering system; Lefranc, M. P. et al. Nucl. Acids Res. 27:209-212 (1999), Ruiz, M. e al. Nucl. Acids Res. 28:219-221 (2000)).

The IMGT unique numbering has been defined to compare the variable domains whatever the antigen receptor, the chain type, or the species [Lefranc M.-P., Immunology Today 18, 509 (1997)/Lefranc M.-P., The Immunologist, 7, 132-136 (1999)/Lefranc, M.-P., Pommie, C., Ruiz, M., Giudicelli, V., Foulquier, E., Truong, L., Thouvenin-Contet, V. and Lefranc, Dev. Comp. Immunol., 27, 55-77 (2003)]. In the IMGT unique numbering, the conserved amino acids always have the same position, for instance cysteine 23 (1st-CYS), tryptophan 41 (CONSERVED-TRP), hydrophobic amino acid 89, cysteine 104 (2nd-CYS), phenylalanine or tryptophan 118 (J-PHE or J-TRP). The IMGT unique numbering provides a standardized delimitation of the framework regions (FR1-IMGT: positions 1 to 26, FR2-IMGT: 39 to 55, FR3-IMGT: 66 to 104 and FR4-IMGT: 118 to 128) and of the complementarity determining regions: CDR1-IMGT: 27 to 38, CDR2-IMGT: 56 to 65 and CDR3-IMGT: 105 to 117. As gaps represent unoccupied positions, the CDR-IMGT lengths (shown between brackets and separated by dots, e.g. [8.8.13]) become crucial information. The IMGT unique numbering is used in 2D graphical representations, designated as IMGT Colliers de Perles (Ruiz, M. and Lefranc, M.-P., Immunogenetics, 53, 857-883 (2002)/Kaas, Q. and Lefranc, M.-P., Current Bioinformatics, 2, 21-30 (2007)), and in 3D structures in IMGT/3Dstructure-DB (Kaas, Q., Ruiz, M. and Lefranc, M.-P., T cell receptor and MHC structural data. Nucl. Acids. Res., 32, D208-D210 (2004)).

In some embodiments, CDRs are determined based on cross-species sequence variability (i.e., Kabat et al. Sequences of Proteins of Immunological Interest, (5th ed., 1991, National Institutes of Health, Bethesda Md.)). In some embodiments, CDRs are determined based on crystallographic studies of antigen-antibody complexes (Al-lazikani et al (1997) J. Molec. Biol. 273:927-948)). In addition, combinations of these two approaches can be used to determine CDRs. In some embodiments, the CDRs are determined based on AHo (Honegger and Pluckthun, J. Mol. Biol. 309(3):657-670; 2001). In some embodiments, CDRs are determined based on the IMGT system.

The term "human antibody" means an antibody produced by a human or an antibody having an amino acid sequence corresponding to an antibody produced by a human made using any technique known in the art. This definition of a human antibody includes intact or full-length antibodies, fragments thereof, and/or antibodies comprising at least one human heavy and/or light chain polypeptide such as, for example, an antibody comprising murine light chain and human heavy chain polypeptides.

A "neutralizing antibody" may inhibit the entry of HIV-1 virus for example SF162 and/or JR-CSF with a neutralization index>1.5 or >2.0. (Kostrikis L G et al. J Virol. 1996; 70(1): 445-458.). By "broad and potent neutralizing antibodies" are meant antibodies that neutralize more than one HIV-1 virus species (from diverse clades and different strains within a clade) in a neutralization assay. A broad neutralizing antibody may neutralize at least 2, 3, 4, 5, 6, 7, 8, 9 or more different strains of HIV-1, the strains belonging to the same or different clades. A broad neutralizing antibody may neutralize multiple HIV-1 species belonging to at least 2, 3, 4, 5, or 6 different clades. In some embodiments, the \concentration of the monoclonal antibody able to neutralize at 50% of the input virus in the neutralization assay can be less than about 50 μg/ml.

An "intact" antibody is one that comprises an antigen-binding site as well as a $C_L$ and at least heavy chain constant domains, $C_{H1}$, $C_{H2}$ and $C_{H3}$. The constant domains may be native sequence constant domains (e.g., human native sequence constant domains) or amino acid sequence variants thereof.

The term "chimeric antibodies" refers to antibodies wherein the amino acid sequence of the immunoglobulin molecule is derived from two or more species. Typically, the variable region of both light and heavy chains corresponds to the variable region of antibodies derived from one species of mammals (e.g. mouse, rat, rabbit, etc) with the desired specificity, affinity, and capability while the constant regions are homologous to the sequences in antibodies derived from another (usually human) to avoid eliciting an immune response in that species.

The antibodies herein also include antibodies in which a portion of the heavy and/or light chain is identical with or homologous to corresponding sequences in antibodies belonging to a particular antibody class or subclass, while the remainder of the chain(s) is identical with or homologous to corresponding sequences in antibodies derived from another species or belonging to another antibody class or subclass, as well as fragments of such antibodies.

In some embodiments, the antibody comprises variable region antigen-binding sequences derived from human antibodies (e.g., CDRs) and containing one or more sequences derived from a non-human antibody, e.g., an FR or C region sequence. In some embodiments, the antibody includes those comprising a human variable region antigen binding sequence of one antibody class or subclass and another sequence, e.g., FR or C region sequence, derived from another antibody class or subclass.

In some embodiments, chimeric antibodies may comprise residues that are not found in the recipient antibody or in the donor antibody. In some embodiments, modifications are made to further refine antibody performance. For further details, see Jones et al., *Nature* 321:522-525 (1986); Riechmann et al., *Nature* 332:323-329 (1988); and Presta, *Curr. Op. Struct. Biol.* 2:593-596 (1992).

The term "epitope" or "antigenic determinant" are used interchangeably herein and refer to that portion of an antigen capable of being recognized and specifically bound by a particular antibody. When the antigen is a polypeptide, epitopes can be formed both from contiguous amino acids and noncontiguous amino acids juxtaposed by tertiary folding of a protein. Epitopes formed from contiguous amino acids are typically retained upon protein denaturing, whereas epitopes formed by tertiary folding are typically lost upon protein denaturing. An epitope typically includes at least 3, and more usually, at least 5 or 8-10 amino acids in a unique spatial conformation.

"Binding affinity" generally refers to the strength of the sum total of noncovalent interactions between a single binding site of a molecule (e.g., an antibody) and its binding partner (e.g., an antigen). Unless indicated otherwise, as used herein, "binding affinity" refers to intrinsic binding affinity which reflects a 1:1 interaction between members of a binding pair (e.g., antibody and antigen). The affinity of a molecule X for its partner Y can generally be represented by the dissociation constant (Kd). Low-affinity antibodies generally bind antigen slowly and tend to dissociate readily, whereas high-affinity antibodies generally bind antigen faster and tend to remain bound longer.

The affinity or avidity of an antibody for an antigen can be determined experimentally using any suitable method well known in the art, e.g. flow cytometry, enzyme-linked immunoabsorbent assay (ELISA), or radioimmunoas say (RIA), or kinetics (e.g., BIACORE™ analysis). Direct binding assays as well as competitive binding assay formats can be readily employed. (See, for example, Berzofsky, et al., "Antibody-Antigen Interactions," In Fundamental Immunology, Paul, W. E., Ed., Raven Press: New York, N.Y. (1984); Kuby, Janis Immunology, W.H. Freeman and Company: New York, N.Y. (1992); and methods described herein. The measured affinity of a particular antibody-antigen interaction can vary if measured under different conditions (e.g., salt concentration, pH, temperature). Thus, measurements of affinity and other antigen-binding parameters (e.g., KD or Kd, $K_{on}$, $K_{off}$) are made with standardized solutions of antibody and antigen, and a standardized buffer, as known in the art and such as the buffer described herein.

The phrase "substantially similar," or "substantially the same", as used herein, denotes a sufficiently high degree of similarity between two numeric values (generally one associated with an antibody of the invention and the other associated with a reference/comparator antibody) such that one of skill in the art would consider the difference between the two values to be of little or no biological and/or statistical significance within the context of the biological characteristics measured by said values (e.g., Kd values). The difference between said two values is less than about 500%, less than about 40%, less than about 300%, less than about 200%, or less than about 10% as a function of the value for the reference/comparator antibody.

A polypeptide, antibody, polynucleotide, vector, cell, or composition which is "isolated" is a polypeptide, antibody, polynucleotide, vector, cell, or composition which is in a form not found in nature. Isolated polypeptides, antibodies, polynucleotides, vectors, cell or compositions include those which have been purified to a degree that they are no longer in a form in which they are found in nature. In some embodiments, an antibody, polynucleotide, vector, cell, or composition which is isolated is substantially pure.

An "isolated nucleic acid" is a nucleic acid that is substantially separated from other genome DNA sequences as well as proteins or complexes such as ribosomes and polymerases, which naturally accompany a native sequence. The term embraces a nucleic acid sequence that has been removed from its naturally occurring environment, and includes recombinant or cloned DNA isolates and chemically synthesized analogues or analogues biologically synthesized by heterologous systems. A substantially pure nucleic acid includes isolated forms of the nucleic acid. Of course, this refers to the nucleic acid as originally isolated and does not exclude genes or sequences later added to the isolated nucleic acid by the hand of man.

An "isolated polypeptide" is one that has been identified and separated and/or recovered from a component of its natural environment. In preferred embodiments, the isolated polypeptide will be purified (1) to greater than 95% by weight of polypeptide as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or non-reducing conditions using Coomassie blue or, preferably, silver stain. Isolated polypeptide includes the polypeptide in situ within recombinant cells since at least one component of the polypeptide's natural environment will not be present.

A "native sequence" polynucleotide is one that has the same nucleotide sequence as a polynucleotide derived from nature. A "native sequence" polypeptide is one that has the same amino acid sequence as a polypeptide (e.g., antibody) derived from nature (e.g., from any species). Such native sequence polynucleotides and polypeptides can be isolated from nature. A polynucleotide "variant," as the term is used herein, is a polynucleotide that typically differs from a polynucleotide specifically disclosed herein in one or more substitutions, deletions, additions and/or insertions. Such variants may be naturally occurring or may be synthetically generated, for example, by modifying one or more of the polynucleotide sequences of the invention and evaluating one or more biological activities of the encoded polypeptide as described herein and/or using any of a number of techniques well known in the art.

A polypeptide "variant," as the term is used herein, is a polypeptide that typically differs from a polypeptide specifically disclosed herein in one or more substitutions, deletions, additions and/or insertions. Such variants may be naturally occurring or may be synthetically generated, for example, by modifying one or more of the above polypeptide sequences of the invention and evaluating one or more biological activities of the polypeptide as described herein and/or using any of a number of techniques well known in the art. or can be produced by recombinant or synthetic means.

As used herein, "substantially pure" refers to material which is at least 50% pure (i.e., free from contaminants), at least 90% pure, at least 95% pure, at least 98% pure, or at least 99% pure.

The term "subject" refers to any animal (e.g., a mammal), including, but not limited to humans, non-human primates, rodents, and the like, which is to be the recipient of a particular treatment. Typically, the terms "subject" and "patient" are used interchangeably herein in reference to a human subject.

Administration "in combination with" one or more further therapeutic agents includes simultaneous (concurrent) and consecutive administration in any order.

The term "pharmaceutical formulation" refers to a preparation which is in such form as to permit the biological activity of the active ingredient to be effective, and which contains no additional components which are unacceptably toxic to a subject to which the formulation would be administered. Such formulation can be sterile.

An "effective amount" of an antibody as disclosed herein is an amount sufficient to carry out a specifically stated purpose. An "effective amount" can be determined empirically and in a routine manner, in relation to the stated purpose.

The term "therapeutically effective amount" refers to an amount of an antibody or other drug effective to "treat" or prevent a disease or disorder in a subject or mammal.

Terms such as "treating" or "treatment" or "to treat" or "alleviating" or "to alleviate" refer to both 1) therapeutic measures that cure, slow down, lessen symptoms of, and/or halt progression of a diagnosed pathologic condition or disorder and 2) prophylactic or preventative measures that prevent and/or slow the development of a targeted pathologic condition or disorder. Thus, those in need of treatment include those already with the disorder; those prone to have the disorder; and those in whom the disorder is to be prevented.

"Polynucleotide," or "nucleic acid," as used interchangeably herein, refer to polymers of nucleotides of any length, and include DNA and RNA. The nucleotides can be deoxyribonucleotides, ribonucleotides, modified nucleotides or bases, and/or their analogs, or any substrate that can be incorporated into a polymer by DNA or RNA polymerase. A polynucleotide can comprise modified nucleotides, such as methylated nucleotides and their analogs. If present, modification to the nucleotide structure can be imparted before or after assembly of the polymer. The sequence of nucleotides can be interrupted by non-nucleotide components. A polynucleotide can be further modified after polymerization, such as by conjugation with a labeling component. Other types of modifications include, for example, "caps", substitution of one or more of the naturally occurring nucleotides with an analog, internucleotide modifications such as, for example, those with uncharged linkages (e.g., methyl phosphonates, phosphotriesters, phosphoamidates, cabamates, etc.) and with charged linkages (e.g., phosphorothioates, phosphorodithioates, etc.), those containing pendant moieties, such as, for example, proteins (e.g., nucleases, toxins, antibodies, signal peptides, ply-L-lysine, etc.), those with intercalators (e.g., acridine, psoralen, etc.), those containing chelators (e.g., metals, radioactive metals, boron, oxidative metals, etc.), those containing alkylators, those with modified linkages (e.g., alpha anomeric nucleic acids, etc.), as well as unmodified forms of the polynucleotide(s). Further, any of the hydroxyl groups ordinarily present in the sugars can be replaced, for example, by phosphonate groups, phosphate groups, protected by standard protecting groups, or activated to prepare additional linkages to additional nucleotides, or can be conjugated to solid supports. The 5' and 3' terminal OH can be phosphorylated or substituted with amines or organic capping group moieties of from 1 to 20 carbon atoms. Other hydroxyls can also be derivatized to standard protecting groups. Polynucleotides can also contain analogous forms of ribose or deoxyribose sugars that are generally known in the art, including, for example, 2'-O-methyl-, 2'-O-allyl, 2'-fluoro- or 2'-azido-ribose, carbocyclic sugar analogs, alpha.-anomeric sugars, epimeric sugars such as arabinose, xyloses or lyxoses, pyranose sugars, furanose sugars, sedoheptuloses, acyclic analogs and abasic nucleoside analogs such as methyl riboside. One or more phosphodiester linkages can be replaced by alternative linking groups. These alternative linking groups include, but are not limited to, embodiments wherein phosphate is replaced by P(O)S ("thioate"), P(S)S ("dithioate"), "(O)NR$_2$ ("amidate"), P(O)R, P(O)OR', CO or CH$_2$ ("formacetal"), in which each R or R' is independently H or substituted or unsubstituted alkyl (1-20 C) optionally containing an ether (—O—) linkage, aryl, alkenyl, cycloalkyl, cycloalkenyl or araldyl. Not all linkages in a polynucleotide need be identical. The preceding description applies to all polynucleotides referred to herein, including RNA and DNA.

The terms "polypeptide," "peptide," and "protein" are used interchangeably herein to refer to polymers of amino acids of any length. The polymer can be linear or branched, it can comprise modified amino acids, and it can be interrupted by non-amino acids. The terms also encompass an amino acid polymer that has been modified naturally or by intervention; for example, disulfide bond formation, glycosylation, lipidation, acetylation, phosphorylation, or any other manipulation or modification, such as conjugation with a labeling component. Also included within the definition are, for example, polypeptides containing one or more analogs of an amino acid (including, for example, unnatural amino acids, etc.), as well as other modifications known in the art. It is understood that, because the polypeptides of this invention are based upon antibodies, in certain embodiments, the polypeptides can occur as single chains or associated chains.

The terms "identical" or percent "identity" in the context of two or more nucleic acids or polypeptides, refer to two or more sequences or subsequences that are the same or have a specified percentage of nucleotides or amino acid residues that are the same, when compared and aligned (introducing gaps, if necessary) for maximum correspondence, not considering any conservative amino acid substitutions as part of the sequence identity. The percent identity can be measured using sequence comparison software or algorithms or by visual inspection. Various algorithms and software are known in the art that can be used to obtain alignments of amino acid or nucleotide sequences. One such non-limiting example of a sequence alignment algorithm is the algorithm described in Karlin et al, 1990, Proc. Natl. Acad. Sci., 87:2264-2268, as modified in Karlin et al., 1993, Proc. Natl. Acad. Sci., 90:5873-5877, and incorporated into the NBLAST and XBLAST programs (Altschul et al., 1991, Nucleic Acids Res., 25:3389-3402). In certain embodiments, Gapped BLAST can be used as described in Altschul et al., 1997, Nucleic Acids Res. 25:3389-3402. BLAST-2, WU-BLAST-2 (Altschul et al., 1996, Methods in Enzymology, 266:460-480), ALIGN, ALIGN-2 (Genentech, South San Francisco, Calif.) or Megalign (DNASTAR) are additional publicly available software programs that can be used to align sequences. In certain embodiments, the percent identity between two nucleotide sequences is determined using the GAP program in GCG software (e.g., using a NWSgap-dna.CMP matrix and a gap weight of 40, 50, 60, 70, or 90 and a length weight of 1, 2, 3, 4, 5, or 6). In certain alternative embodiments, the GAP program in the GCG software package, which incorporates the algorithm of Needleman and Wunsch (J. Mol. Biol. (48):444-453 (1970)) can be used to determine the percent identity between two amino acid sequences (e.g., using either a Blossum 62 matrix or a PAM250 matrix, and a gap weight of 16, 14, 12, 10, 8, 6, or 4 and a length weight of 1, 2, 3, 4, 5). Alternatively, in certain embodiments, the percent identity between nucleotide or amino acid sequences is determined using the algorithm of Myers and Miller (CABIOS, 4:11-17 (1989)). For example, the percent identity can be determined using the ALIGN program (version 2.0) and using a PAM120 with residue table, a gap length penalty of 12 and a gap penalty of 4. Appropriate parameters for maximal alignment by particular alignment software can be determined by one skilled in the art. In certain embodiments, the default parameters of the alignment software are used. In certain embodiments, the percentage identity "X" of a first amino acid sequence to a second sequence amino acid is calculated as 100.times.(Y/Z), where Y is the number of amino acid residues scored as identical matches in the alignment of the first and second sequences (as aligned by visual inspection or a particular sequence alignment program) and Z is the total number of residues in the second sequence. If the length of a first sequence is longer than the second sequence, the percent identity of the first sequence to the second sequence will be longer than the percent identity of the second sequence to the first sequence.

As a non-limiting example, whether any particular polynucleotide has a certain percentage sequence identity (e.g., is at least 80% identical, at least 85% identical, at least 90% identical, and in some embodiments, at least 95%, 96%, 97%, 98%, or 99% identical) to a reference sequence can, in certain embodiments, be determined using the Bestfit program (Wisconsin Sequence Analysis Package, Version 8 for Unix, Genetics Computer Group, University Research Park, 575 Science Drive, Madison, Wis. 53711). Bestfit uses the local homology algorithm of Smith and Waterman. Advances in Applied Mathematics 2: 482 489 (1981), to find the best segment of homology between two sequences. When using Bestfit or any other sequence alignment program to determine whether a particular sequence is, for instance, 95% identical to a reference sequence according to the present invention, the parameters are set such that the percentage of identity is calculated over the full length of the reference nucleotide sequence and that gaps in homology of up to 5% of the total number of nucleotides in the reference sequence are allowed.

In some embodiments, two nucleic acids or polypeptides of the invention are substantially identical, meaning they have at least 70%, at least 75%, at least 80%, at least 85%, at least 90%, and in some embodiments at least 95%, 96%, 97%, 98%, 99% nucleotide or amino acid residue identity, when compared and aligned for maximum correspondence, as measured using a sequence comparison algorithm or by visual inspection. In certain embodiments, identity exists over a region of the sequences that is at least about 10, about 20, about 40-60 residues in length or any integral value therebetween, or over a longer region than 60-80 residues, at least about 90-100 residues, or the sequences are substantially identical over the full length of the sequences being compared, such as the coding region of a nucleotide sequence for example.

A "conservative amino acid substitution" is one in which one amino acid residue is replaced with another amino acid residue having a similar side chain. Families of amino acid residues having similar side chains have been defined in the art, including basic side chains (e.g., lysine, arginine, histidine), acidic side chains (e.g., aspartic acid, glutamic acid), uncharged polar side chains (e.g., asparagine, glutamine, serine, threonine, tyrosine, cysteine), nonpolar side chains (e.g., glycine, alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). For example, substitution of a phenylalanine for a tyrosine is a conservative substitution. In certain embodiments, conservative substitutions in the sequences of the polypeptides and antibodies of the invention do not abrogate the binding of the polypeptide or antibody containing the amino acid sequence, to the antigen(s), i.e., the gp120 to which the polypeptide or antibody binds. Methods of identifying nucleotide and amino acid conservative substitutions which do not eliminate antigen binding are well-known in the art (see, e.g., Brummell et al., Biochem. 32: 1180-1187 (1993); Kobayashi et al. Protein Eng. 12(10):879-884 (1999); and Burks et al. Proc. Natl. Acad. Sci. USA 94:412-417 (1997)).

Anti-HIV Antibodies

In some embodiments, the invention provides antibodies that are broadly neutralizing antibodies against HIV.

HIV-1 is among the most genetically diverse viral pathogens. Of the three main branches of the HIV-1 phylogenetic tree, the M (main), N (new), and O (outlier) groups, group M viruses are the most widespread, accounting for over 99% of global infections. This group is presently divided into nine distinct genetic subtypes, or clades (A through K), based on full-length sequences. Env is the most variable HIV-1 gene, with up to 35% sequence diversity between clades, 20% sequence diversity within clades, and up to 10% sequence diversity in a single infected person (Shankarappa, R. et al. 1999. *J. Virol.* 73:10489-10502). Clade B is dominant in Europe, the Americas, and Australia. Clade C is common in southern Africa, China, and India and presently infects more people worldwide than any other clade (McCutchan, F E. 2000. Understanding the genetic diversity of HIV-1. *AIDS* 14(Suppl. 3):531-544). Clades A and D are prominent in central and eastern Africa.

In some embodiments, the invention provides antibodies that are broadly neutralizing against HIV. In some embodiments, the antibody has a particularly high potency in neutralizing HIV infection in vitro across multiple clades as shown in the Figures and Tables 5, 6, and 16-21 herein. Such antibodies are desirable, as only low concentrations are required in order to neutralize a given amount of virus. This facilitates higher levels of protection while administering lower amounts of antibody.

In some embodiments, the invention provides a broadly neutralizing anti-HIV antibody wherein the antibody neutralizes HIV-1 species belonging to two or more clades.

In some embodiments, the anti-HIV antibody neutralizes at least 95%, at least 96%, at least 97%, at least 98%, at least 99% or 100% of the HIV pseudoviruses listed in Table 1 with an IC50 value of less than 50 μg/mL. In some embodiments, the antibody is selected from N49P6 or an antigen binding fragment thereof, N49P7 or an antigen binding fragment thereof, N49P7.1 or an antigen binding fragment thereof, or N49P11 or an antigen binding fragment thereof. In some embodiments, the antibody comprises the VH and VL regions of N49P6, N49P7, N49P7.1 or N49P11 as described herein. In some embodiments, the antibody comprises the CDRs of the VH and VL regions of N49P6, N49P7, N49P7.1 or N49P11 as described herein.

In some embodiments, the anti-HIV antibody neutralizes 100% of the HIV clade B, G and D viruses listed in Table 1 with an IC50 value of less than 50 μg/mL. See also FIG. 8 and Tables 16-21 herein. In some embodiments, the antibody is selected from N49P6 or an antigen binding fragment thereof, N49P7 or an antigen binding fragment thereof, N49P7.1 or an antigen binding fragment thereof, N49P11 or an antigen binding fragment thereof, or N49P9 or an antigen binding fragment thereof. In some embodiments, the antibody comprises the VH and/or VL regions of N49P6, N49P7, N49P7.1, N49P11 or N49P9 as described herein. In some embodiments, the antibody comprises the CDRs of the VH and VL regions of N49P6, N49P7, N49P7.1, N49P11 or N49P9 as described herein.

In some embodiments, the anti-HIV antibody neutralizes 100% of the HIV pseudoviruses listed in Table 1 with an IC50 value of less than 50 μg/mL. In some embodiments, the anti-HIV antibody neutralizes at least 95%, at least 96%, at least 97%, at least 98%, at least 99% or 100% of the HIV pseudoviruses encompassed by Table 1 and strain CNE5 (clade CRF01_AE) with an IC50 value of less than 50 μg/mL. In some embodiments, the antibody is selected from N49P6 or an antigen binding fragment thereof, N49P7 or an antigen binding fragment thereof, N49P7.1 or an antigen binding fragment thereof, or N49P11 or an antigen binding fragment thereof. In some embodiments, the antibody comprises the VH and VL regions of N49P6, N49P7, N49P7.1 or N49P11 as described herein. In some embodiments, the antibody comprises the CDRs of the VH and VL regions of N49P6, N49P7, N49P7.1 or N49P11 as described herein.

In embodiment aspect, the invention provides an isolated anti-HIV antibody, wherein the antibody is capable of neutralizing HIV pseudoviruses listed in Table 1 with a median IC50 value of less than 0.5 μg/mL. In some embodiments, the antibody is selected from the group consisting of
a. N49P6 or an antigen binding fragment thereof;
b. N49P7 or an antigen binding fragment thereof;
c. N49P7.1 or an antigen binding fragment thereof
d. N49P9 or an antigen binding fragment thereof; and
e. N49P23 or an antigen binding fragment thereof.

In some embodiments, the anti-HIV antibody neutralizes at least 50%, at least 55%, at least 60%, at least 65%, at least 70%, at least 75%, at least 80%, at least 85%, at least 90%, at least 95%, or at least 99% of the HIV pseudoviruses listed in Table 1 with an IC50 value of less than about 1 μg/ml, between about 1-5 μg/ml or greater than about 5 μg/ml.

In some embodiments, the anti-HIV antibody neutralizes at least about 86.4% of the HIV pseudoviruses listed in Table 1 with an IC50 value of less than 1 μg/mL. In some embodiments, the antibody is N49P7 or an antigen binding fragment thereof. In some embodiments, the antibody comprises the VH and VL regions of N49P7 as described herein. In some embodiments, the antibody comprises the CDRs of the VH and VL regions of N49P7 as described herein.

In some embodiments, the anti-HIV antibody neutralizes at least 88.7% of the HIV pseudoviruses listed in Table 1 with an IC50 value of less than 1 μg/mL. In some embodiments, the antibody is N49P7.1 or an antigen binding fragment thereof. In some embodiments, the antibody comprises the VH and VL regions of N49P7.1 as described herein. In some embodiments, the antibody comprises the CDRs of the VH and VL regions of N49P7.1 as described herein.

In some embodiments, the anti-HIV antibody neutralizes at least 84.5% of the HIV pseudoviruses listed in Table 1 with an IC50 value of less than 1 μg/mL. In some embodiments, the antibody is N49P7.2 or an antigen binding fragment thereof. In some embodiments, the antibody comprises the VH and VL regions of N49P7.2 as described herein. In some embodiments, the antibody comprises the CDRs of the VH and VL regions of N49P7.2 as described herein.

In some embodiments, the anti-HIV antibody neutralizes at least 71.8% of the HIV pseudoviruses listed in Table 1 with an IC50 value of less than 1 μg/mL. In some embodiments, the antibody is N49P6 or an antigen binding fragment thereof. In some embodiments, the antibody comprises the VH and VL regions of N49P6 as described herein. In some embodiments, the antibody comprises the CDRs of the VH and VL regions of N49P6 as described herein.

In some embodiments, the anti-HIV antibody neutralizes at least 93.3% of the HIV pseudoviruses listed in Table 1 with an IC50 value of less than 1 μg/mL. In some embodiments, the antibody is N49P9 or an antigen binding fragment thereof. In some embodiments, the antibody comprises the VH and VL regions of N49P9 as described herein. In some embodiments, the antibody comprises the CDRs of the VH and VL regions of N49P9 as described herein.

In some embodiments, the anti-HIV antibody neutralizes at least 91.1% of the HIV pseudoviruses listed in Table 1 with an IC50 value of less than 1 μg/mL. In some embodiments, the antibody is N49P9.1 or an antigen binding fragment thereof. In some embodiments, the antibody comprises the VH and VL regions of N49P9.1 as described herein. In some embodiments, the antibody comprises the CDRs of the VH and VL regions of N49P9.1 as described herein.

In some embodiments, the anti-HIV antibody neutralizes at least 41.9% of the HIV pseudoviruses listed in Table 1 with an IC50 value of less than 1 μg/mL. In some embodiments, the antibody is N49P11 or an antigen binding fragment thereof. In some embodiments, the antibody comprises the VH and VL regions of N49P11 as described herein. In some embodiments, the antibody comprises the CDRs of the VH and VL regions of N49P11 as described herein.

In some embodiments, the anti-HIV antibody neutralizes at least 2.1% of the HIV pseudoviruses listed in Table 1 with an IC50 value of less than 1 μg/mL. In some embodiments, the antibody is N49P18.1 or an antigen binding fragment thereof. In some embodiments, the antibody comprises the VH and VL regions of N49P18.1 as described herein. In some embodiments, the antibody comprises the CDRs of the VH and VL regions of N49P18.1 as described herein.

In some embodiments, the anti-HIV antibody neutralizes at least 60% of the HIV pseudoviruses listed in Table 1 with an IC50 value of less than 1 μg/mL. In some embodiments, the antibody is N49P19 or an antigen binding fragment thereof. In some embodiments, the antibody comprises the VH and VL regions of N49P19 as described herein. In some embodiments, the antibody comprises the CDRs of the VH and VL regions of N49P19 as described herein.

In some embodiments, the anti-HIV antibody neutralizes at least 58.3% of the HIV viruses listed in Table 1 with an IC50 value of less than 1 μg/mL. In some embodiments, the antibody is N49P22 or an antigen binding fragment thereof. In some embodiments, the antibody comprises the VH and VL regions of N49P22 as described herein. In some embodiments, the antibody comprises the CDRs of the VH and VL regions regions of N49P22 as described herein.

In some embodiments, the anti-HIV antibody neutralizes at least 88.6% of the HIV viruses listed in Table 1 with an IC50 value of less than 1 μg/mL. In some embodiments, the antibody is N49P23 or an antigen binding fragment thereof. In some embodiments, the antibody comprises the VH and VL regions of N49P23 as described herein. In some embodiments, the antibody comprises the CDRs of the VH and VL regions of N49P23 as described herein.

The neutralization can be performed using a luciferase-based assay in TZM.bl cells as described by M. M. Sajadi et al., *J Acquir Immune Defic Syndr* 57, 9-15 (2011) and M. Li et al., *J Virol* 79, 10108-10125 (2005)). This assay measures the reduction in luciferase expression following a single round of virus infection.

TABLE 1

HIV Env pseudovirus panel.

| Virus ID | Clade* |
|---|---|
| 6535.3 | B |
| QH0692.42 | B |
| SC422661.8 | B |
| PV0.4 | B |
| TRO.11 | B |
| AC10.0.29 | B |
| RHPA4259.7 | B |
| THRO4156.18 | B |
| REJO4541.67 | B |
| TRJO4551.58 | B |
| WITO4160.33 | B |
| CAAN5342.A2 | B |
| WEAU_d15_410_787 | B (T/F) |
| 1006_11_C3_1601 | B (T/F) |
| 1054_07_TC4_1499 | B (T/F) |
| 1056_10_TA11_1826 | B (T/F) |
| 1012_11_TC21_3257 | B (T/F) |

TABLE 1-continued

HIV Env pseudovirus panel.

| Virus ID | Clade* |
|---|---|
| 6240_08_TA5_4622 | B (T/F) |
| 6244_13_B5_4576 | B (T/F) |
| 62357_14_D3_4589 | B (T/F) |
| SC05_8C11_2344 | B (T/F) |
| Du156.12 | C |
| Du172.17 | C |
| Du422.1 | C |
| ZM197M.PB7 | C |
| ZM214M.PL15 | C |
| ZM233M.PB6 | C |
| ZM249M.PL1 | C |
| ZM53M.PB12 | C |
| ZM109F.PB4 | C |
| ZM135M.PL10a | C |
| CAP45.2.00.G3 | C |
| CAP210.2.00.E8 | C |
| HIV-001428-2.42 | C |
| HIV-0013095-2.11 | C |
| HIV-16055-2.3 | C |
| HIV-16845-2.22 | C |
| Ce1086_B2 | C (T/F) |
| Ce0393_C3 | C (T/F) |
| Ce1176_A3 | C (T/F) |
| Ce2010_F5 | C (T/F) |
| Ce0682_E4 | C (T/F) |
| Ce1172_H1 | C (T/F) |
| Ce2060_G9 | C (T/F) |
| Ce703010054_2A2 | C (T/F) |
| BF1266.431a | C (T/F) |
| 246F C1G | C (T/F) |
| 249M B10 | C (T/F) |
| ZM247v1(Rev−) | C (T/F) |
| 7030102001E5(Rev−) | C (T/F) |
| 1394C9G1(Rev−) | C (T/F) |
| Ce704809221_1B3 | C (T/F) |
| CNE19 | BC |
| CNE20 | BC |
| CNE21 | BC |
| CNE17 | BC |
| CNE30 | BC |
| CNE52 | BC |
| CNE53 | BC |
| CNE58 | BC |
| MS208.A1 | A |
| Q23.17 | A |
| Q461.e2 | A |
| Q769.d22 | A |
| Q259.d2.17 | A |
| Q842.d12 | A |
| 3415.v1.c1 | A |
| 3365.v2.c2 | A |
| 0260.v5.c36 | A |
| 191955_A11 | A (T/F) |
| 191084 B7-19 | A (T/F) |
| 9004SS_A3_4 | A (T/F) |
| T257-31 | CRF02_AG |
| 928-28 | CRF02_AG |
| 263-8 | CRF02_AG |
| T250-4 | CRF02_AG |
| T251-18 | CRF02_AG |
| T278-50 | CRF02_AG |
| T255-34 | CRF02_AG |
| 211-9 | CRF02_AG |
| 235-47 | CRF02_AG |
| 620345.c01 | CRF01_AE |
| CNE8 | CRF01_AE |
| C1080.c03 | CRF01_AE |
| R2184.c04 | CRF01_AE |
| R1166.c01 | CRF01_AE |
| R3265.c06 | CRF01_AE |
| C2101.c01 | CRF01_AE |
| C3347.c11 | CRF01_AE |
| C4118.c09 | CRF01_AE |
| BJOX009000.02.4 | CRF01_AE |
| BJOX015000.11.5 | CRF01_AE (T/F) |
| BJOX010000.06.2 | CRF01_AE (T/F) |

TABLE 1-continued

HIV Env pseudovirus panel.

| Virus ID | Clade* |
|---|---|
| BJOX025000.01.1 | CRF01_AE (T/F) |
| BJOX028000.10.3 | CRF01_AE (T/F) |
| X1193_c1 | G |
| P0402_c2_11 | G |
| X1254_c3 | G |
| X2088_c9 | G |
| X2131_C1_B5 | G |
| P1981_C5_3 | G |
| X1632_S2_B10 | G |
| 3016.v5.c45 | D |
| A07412M1.vrc12 | D |
| 231965.c01 | D |
| 231966.c02 | D |
| 3817.v2.c59 | CD |
| 6480.v4.c25 | CD |
| 6952.v1.c20 | CD |
| 6811.v7.c18 | CD |
| 89-F1_2_25 | CD |
| 3301.v1.c24 | AC |
| 6041.v3.c23 | AC |
| 6540.v4.c1 | AC |
| 6545.v4.c1 | AC |
| 0815.v3.c3 | ACD |
| 3103.v3.c10 | ACD |

*(T/F): Transmitted/Founder Virus

Methods for producing antibodies, such as those disclosed herein, are known in the art. For example, DNA molecules encoding light chain variable regions and/or heavy chain variable regions can be chemically synthesized using the sequence information provided herein. Synthetic DNA molecules can be ligated to other appropriate nucleotide sequences, including, e.g., expression control sequences, to produce conventional gene expression constructs encoding the desired antibodies. Production of defined gene constructs is within routine skill in the art. Alternatively, the sequences provided herein can be cloned out of hybridomas by conventional hybridization techniques or polymerase chain reaction (PCR) techniques, using synthetic nucleic acid probes whose sequences are based on sequence information provided herein, or prior art sequence information regarding genes encoding the heavy and light chains.

Standard techniques of molecular biology may be used to prepare DNA sequences coding for the antibodies or fragments of the antibodies of the present invention. Desired DNA sequences may be synthesized completely or in part using oligonucleotide synthesis techniques. Site-directed mutagenesis and polymerase chain reaction (PCR) techniques may be used as appropriate.

Any suitable host cell/vector system may be used for expression of the DNA sequences encoding the antibody molecules of the present invention or fragments thereof. Bacterial, for example *E. coli*, and other microbial systems may be used, in part, for expression of antibody fragments such as Fab and F(ab')2 fragments, and especially Fv fragments and single chain antibody fragments, for example, single chain Fvs. Eukaryotic, e.g. mammalian, host cell expression systems may be used for production of larger antibody molecules, including complete antibody molecules. Suitable mammalian host cells include CHO, HEK293T, PER.C6, myeloma or hybridoma cells.

In some embodiments, antibodies according to the invention may be produced by i) expressing a nucleic acid sequence according to the invention in a cell, and ii) isolating the expressed antibody product. Additionally, the method may include iii) purifying the antibody.

For the antibodies of the present invention to be expressed, the protein coding sequence should be "operably linked" to regulatory or nucleic acid control sequences that direct transcription and translation of the protein. As used herein, a coding sequence and a nucleic acid control sequence or promoter are said to be "operably linked" when they are covalently linked in such a way as to place the expression or transcription and/or translation of the coding sequence under the influence or control of the nucleic acid control sequence. The "nucleic acid control sequence" can be any nucleic acid element, such as, but not limited to promoters, enhancers, IRES, introns, and other elements described herein that direct the expression of a nucleic acid sequence or coding sequence that is operably linked thereto. The term "promoter" will be used herein to refer to a group of transcriptional control modules that are clustered around the initiation site for RNA polymerase II and that when operationally linked to the protein coding sequences of the invention lead to the expression of the encoded protein. The expression of the antibodies of the present invention can be under the control of a constitutive promoter or of an inducible promoter, which initiates transcription only when exposed to some particular external stimulus, such as, without limitation, antibiotics such as tetracycline, hormones such as ecdysone, or heavy metals. The promoter can also be specific to a particular cell-type, tissue or organ. Many suitable promoters and enhancers are known in the art, and any such suitable promoter or enhancer may be used for expression of the antibodies of the invention. For example, suitable promoters and/or enhancers can be selected from the Eukaryotic Promoter Database (EPDB).

Nucleic acids encoding desired antibodies can be incorporated (ligated) into expression vectors, which can be introduced into host cells through conventional transfection or transformation techniques. Exemplary host cells are *E. coli* cells, Chinese hamster ovary (CHO) cells, human embryonic kidney 293 (HEK 293) cells, HeLa cells, baby hamster kidney (BHK) cells, monkey kidney cells (COS), human hepatocellular carcinoma cells (e.g., Hep G2), and myeloma cells that do not otherwise produce IgG protein. Transformed host cells can be grown under conditions that permit the host cells to express the genes that encode the immunoglobulin light and/or heavy chain variable regions. Specific expression and purification conditions will vary depending upon the expression system employed.

Following expression, the antibodies and/or antigens of the invention can be isolated and/or purified or concentrated using any suitable technique known in the art. For example, anion or cation exchange chromatography, phosphocellulose chromatography, hydrophobic interaction chromatography, affinity chromatography, immuno-affinity chromatography, hydroxyapatite chromatography, lectin chromatography, molecular sieve chromatography, isoelectric focusing, gel electrophoresis, or any other suitable method or combination of methods can be used.

In some embodiments, the antibodies can be made using recombinant DNA methods as described in U.S. Pat. No. 4,816,567. The polynucleotides encoding a monoclonal antibody can be isolated from mature B-cells or hybridoma cell, such as by RT-PCR using oligonucleotide primers that specifically amplify the genes encoding the heavy and light chains of the antibody, and their sequence is determined using conventional procedures. The isolated polynucleotides encoding the heavy and light chains are then cloned into suitable expression vectors, which when transfected into host cells such as *E. coli* cells, simian COS cells, Chinese hamster ovary (CHO) cells, or myeloma cells that do not otherwise produce immunoglobulin protein, monoclonal antibodies are generated by the host cells.

The anti-HIV antibodies can also include insertions, deletions, substitutions, or other selected modifications of particular regions or specific amino acids residues. It should be understood that the antibodies of the invention may differ from the exact sequences illustrated and described herein. Thus, the invention contemplates deletions, additions and substitutions to the sequences shown, so long as the sequences function in accordance with the methods of the invention. In this regard, particularly preferred substitutions will generally be conservative in nature, i.e., those substitutions that take place within a family of amino acids. For example, amino acids are generally divided into four families: (1) acidic-aspartate and glutamate; (2) basic-lysine, arginine, histidine; (3) non-polar-alanine, valine, leucine, isoleucine, proline, phenylalanine, methionine, tryptophan; and (4) uncharged polar-glycine, asparagine, glutamine, cystine, serine threonine, tyrosine. Phenylalanine, tryptophan, and tyrosine are sometimes classified as aromatic amino acids. For example, leucine can be replaced with isoleucine or valine, or vice versa; an aspartate with a glutamate or vice versa; a threonine with a serine or vice versa; or a similar conservative replacement of an amino acid with a structurally related amino acid can be made.

The polynucleotide(s) encoding a monoclonal antibody can further be modified in a number of different manners using recombinant DNA technology to generate alternative antibodies. In some embodiments, the constant domains of the light and heavy chains of, for example, a mouse monoclonal antibody can be substituted 1) for those regions of, for example, a human antibody to generate a chimeric antibody or 2) for a non-immunoglobulin polypeptide to generate a fusion antibody. In some embodiments, the constant regions are truncated or removed to generate the desired antibody fragment of a monoclonal antibody. Site-directed or high-density mutagenesis of the variable region can be used to optimize specificity, affinity, etc. of a monoclonal antibody.

For the purposes of the present invention, it should be appreciated that modified antibodies can comprise any type of variable region that provides for the association of the antibody with the polypeptides of HIV such as gp120.

In some embodiments, the variable regions or domains in both the heavy and light chains are altered by at least partial replacement of one or more CDRs and, if necessary, by partial framework region replacement and sequence changing. Although the CDRs can be derived from an antibody of the same class or even subclass as the antibody from which the framework regions are derived, in some embodiments the CDRs will be derived from an antibody of different class.

Alterations to the variable region notwithstanding, those skilled in the art will appreciate that the modified antibodies of this invention can comprise antibodies (e.g., full-length antibodies or immunoreactive fragments thereof) in which at least a fraction of one or more of the constant region domains has been deleted or otherwise altered so as to provide desired biochemical characteristics such as increased localization, increased serum half-life or reduced serum half-life when compared with an antibody of approximately the same immunogenicity comprising a native or unaltered constant region. In some embodiments, the constant region of the modified antibodies will comprise a human constant region. Modifications to the constant region compatible with this invention comprise additions, deletions or substitutions of one or more amino acids in one or more domains. That is, the modified antibodies disclosed herein can comprise alterations or modifications to one or more of the three heavy chain constant domains (CH1, CH2 or CH3) and/or to the light chain constant domain (CL). In some embodiments, modified constant regions wherein one or more domains are partially or entirely deleted are contemplated. In some embodiments, the modified antibodies will comprise domain deleted constructs or variants wherein the entire CH2 domain has been removed ($\Delta$CH2 constructs). In some embodiments, the omitted constant region domain will be replaced by a short amino acid spacer (e.g. 10 residues) that provides some of the molecular flexibility typically imparted by the absent constant region.

Besides their configuration, it is known in the art that the constant region mediates several effector functions. For example, binding of the C1 component of complement to antibodies activates the complement system. Activation of complement is important in the opsonisation and lysis of cell pathogens. The activation of complement also stimulates the inflammatory response and can also be involved in autoimmune hypersensitivity. Further, antibodies bind to cells via the Fc region, with a Fc receptor site on the antibody Fc region binding to a Fc receptor (FcR) on a cell. There are a number of Fc receptors which are specific for different classes of antibody, including IgG (gamma receptors), IgE (eta receptors), IgA (alpha receptors) and IgM (mu receptors). Binding of antibody to Fc receptors on cell surfaces triggers a number of important and diverse biological responses including engulfment and destruction of antibody-coated particles, clearance of immune complexes, lysis of antibody-coated target cells by killer cells (called antibody-dependent cell-mediated cytotoxicity, or ADCC), release of inflammatory mediators, placental transfer and control of immunoglobulin production.

In certain embodiments, the anti-HIV antibodies provide for altered effector functions that, in turn, affect the biological profile of the administered antibody. For example, the deletion or inactivation (through point mutations or other means) of a constant region domain can reduce Fc receptor binding of the circulating modified antibody thereby increasing tumor localization. In other cases it may be that constant region modifications, consistent with this invention, moderate complement binding and thus reduce the serum half life and nonspecific association of a conjugated cytotoxin. Yet other modifications of the constant region can be used to eliminate disulfide linkages or oligosaccharide moieties that allow for enhanced localization due to increased antigen specificity or antibody flexibility. Similarly, modifications to the constant region in accordance with this invention can easily be made using well known biochemical or molecular engineering techniques well within the purview of the skilled artisan.

In certain embodiments, the invention provides antibodies or antigen binding fragments that specifically bind to an HIV antigen, such as gp120. In some embodiments, the invention is directed to a broadly neutralizing antibody against HIV wherein the antibody binds an epitope on gp120. In some embodiments, the invention is directed to a broadly neutralizing antibody against HIV wherein the antibody binds an epitope on the CD4 binding site (CD4-BS). In some embodiments, the invention is directed to a broadly neutralizing antibody against HIV wherein the antibody binds an epitope on V1V2 glycan. In some embodiments, the invention is directed to a broadly neutralizing antibody against HIV wherein the antibody binds an epitope on V3 glycan. In some embodiments, the invention is directed to a broadly neutralizing antibody against HIV wherein the antibody binds an epitope on the gp41 membrane-proximal external region.

Figure 21:
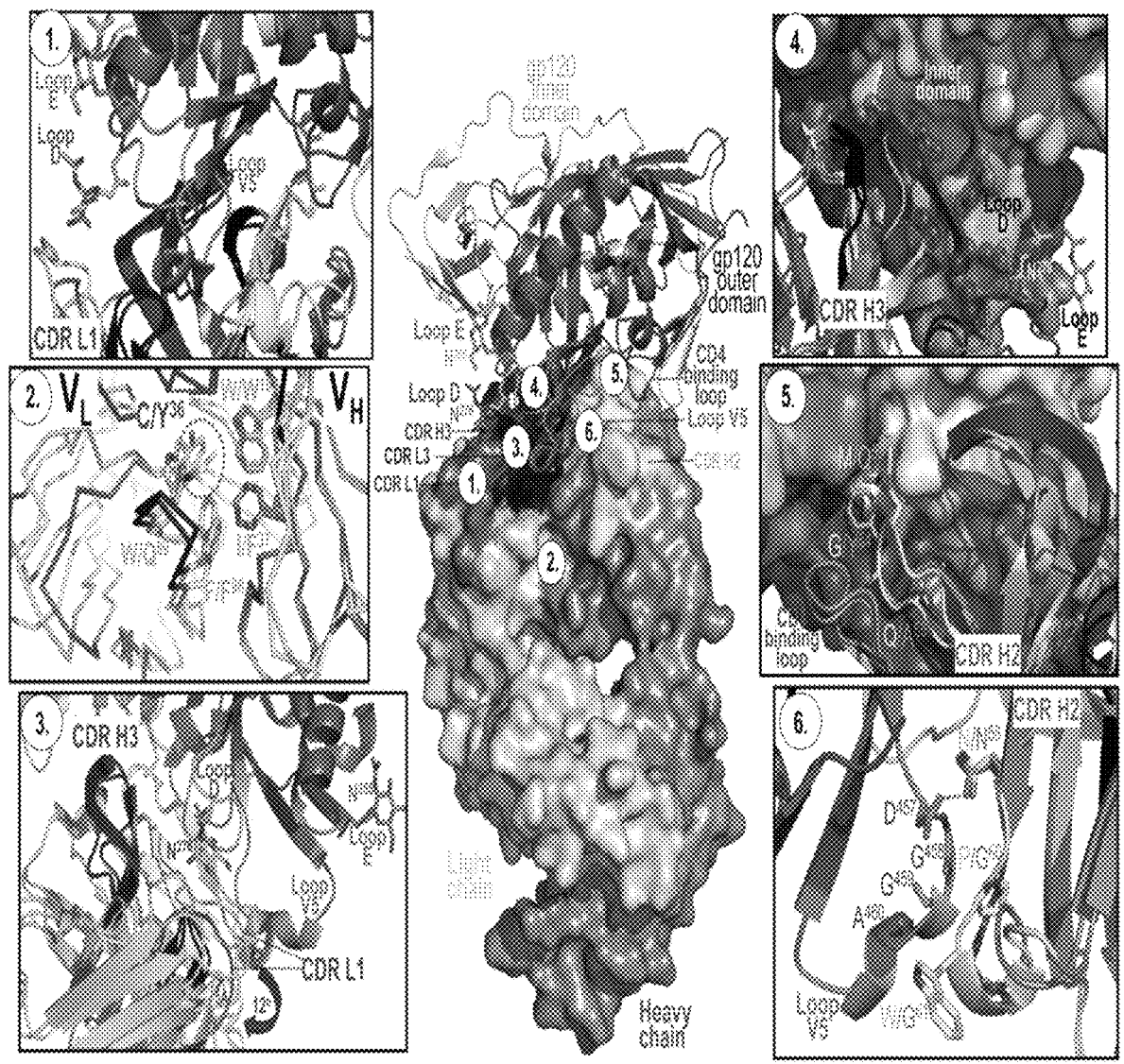
Figure 22:
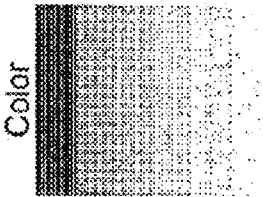
FIG. 22. Comparison of N49P7 to other bNAbs in the literature. Viruses resistant to N6, DH511-2, or 10E8 are shown. N49P7 shows the greatest breadth and overall potency.

X-ray crystallography analysis of pan-neutralizing monoclonal, N49P7, identified its unique ability to bypass the CD4-binding site Phe43 cavity while reaching deep into the highly conserved residues of Layer 3 of the gp120 inner domain, likely accounting for its pan-neutralization. Deletion in the CDR L1 (not found in N6) combined with the rotation/tilting of the light chain 'opens' the variable light (V1) side of the N49P7 antigen binding site to accommodate different lengths of the highly variable loops D, E and VS (FIG. 21). Changes in the length of gp120 loop VS and the length (and glycosylation status) of loop E that cause steric clashes with an antibody light chain were described previously as mechanisms of HIV-I resistance to VRC01-class antibodies (Lynch et al., 2015). These signatures, along with a long CDRH3 (21 aa) and unique sequence signatures within CDR.B2 (not seen in VRCO1 and N6, FIG. 21), allow N49P7 to bypass the Phe43 cavity affording it an unusual capacity to contact the gp120 inner domain at residues 97, 102 and 124 of Layer 2, and 472-480 of Layer 3.

In some embodiments, the conformational interdomain CD4 binding site epitope is formed by combination of residues of both outer and inner domain of gp120 of HIV Env. These generally involve residues of gp120 outer domain at position (HXBc2 numbering): 275-283 (Loop D), 354-371 (CD4 binding loop), 427-439 (bridging sheet) and 455-463 (loop V5) and residues of gp120 inner domain at positions: 96-106 (helix alpha-1 of Layer 2) and 469-480 (loop prior and helix alpha-5 of Layer 3).

Figure 15A:
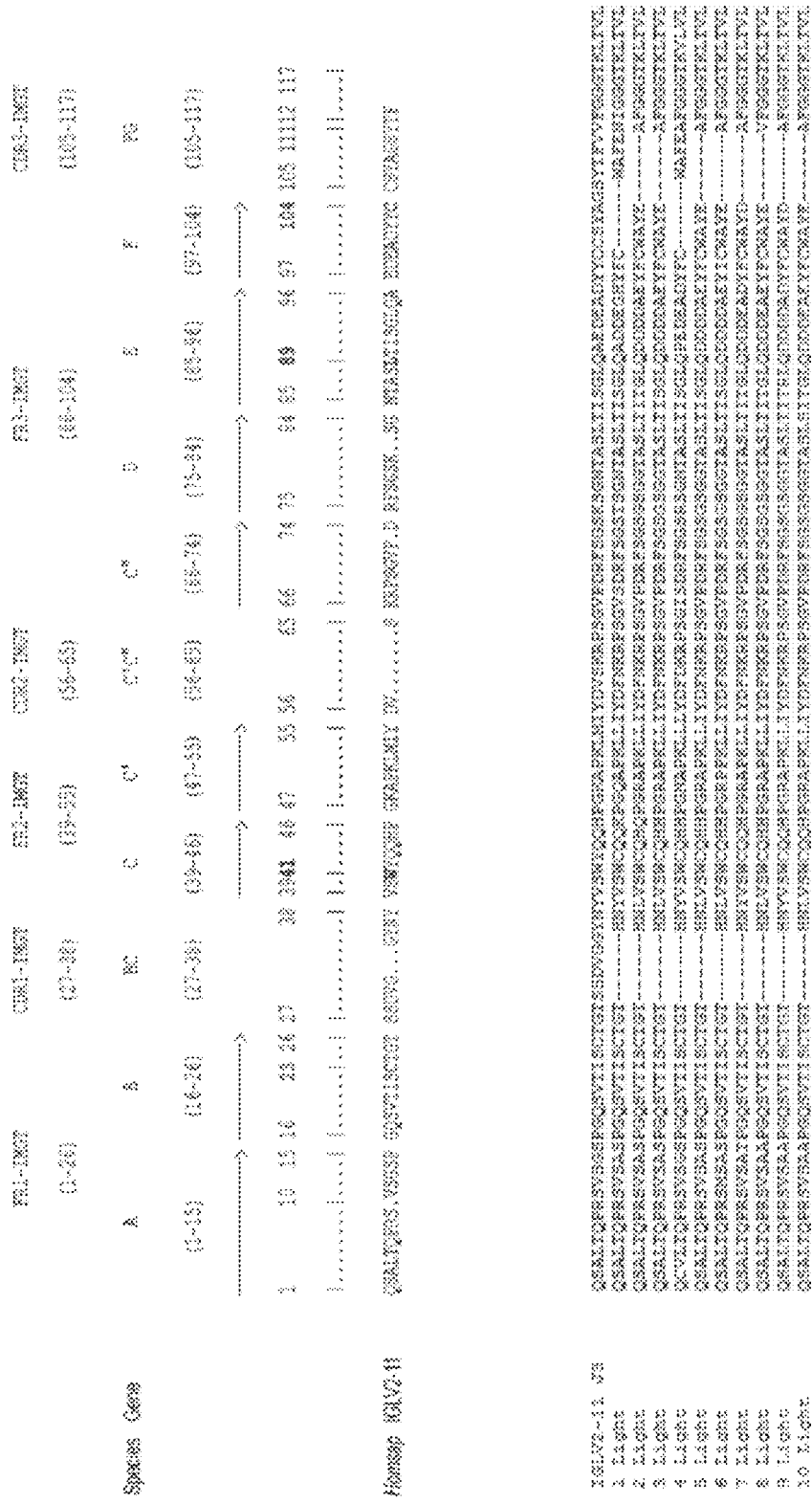

In some embodiments, the anti-HIV antibody binds to a HIV gp120 epitope comprising outer domain loop D (which comprises 275-283), the CD4 binding loop (which comprises 354-371), the bridging sheet (which comprises 427-439) and loop V5 (which comprises 455-463) and gp120 inner domain at positions 96-106 (helix alpha-1 of Layer 2) and 469-480 (loop prior and helix alpha-5 of Layer 3). In some embodiments, the anti-HIV antibody binding the aforementioned epitope is from the antibody lineage as shown in FIG. 15A. In some embodiments, the anti-HIV antibody is selected from N49P6 or an antigen binding fragment thereof, N49P7 or an antigen binding fragment thereof, N49P7.1 or an antigen binding fragment thereof, and N49P11 or an antigen binding fragment thereof. In some embodiments, the antibody comprises the VH and VL regions of N49P6, N49P7, N49P7.1 or N49P11 as described herein. In some embodiments, the antibody comprises the CDRs of the VH and VL regions of N49P6, N49P7, N49P7.1 or N49P11 as described herein. In some embodiments, the antibody has a Kd for BaL-gp120 of at least about $1.59 \times 10^{-8}$ M. In some embodiments, the antibody has a Kd for BaL-gp120 of at least about $1.562 \times 10^{-8}$ M. In some embodiments, the antibody has a Kd for BaL-gp120 of at least about $1.143 \times 10^{-9}$ M. In some embodiments, the antibody has a Kd for BaL-gp120 of at least about $8.602 \times 10^{-10}$ M. In some embodiments, the binding affinity is determined by surface plasmon resonance. See FIG. 10.

Figure 20A:
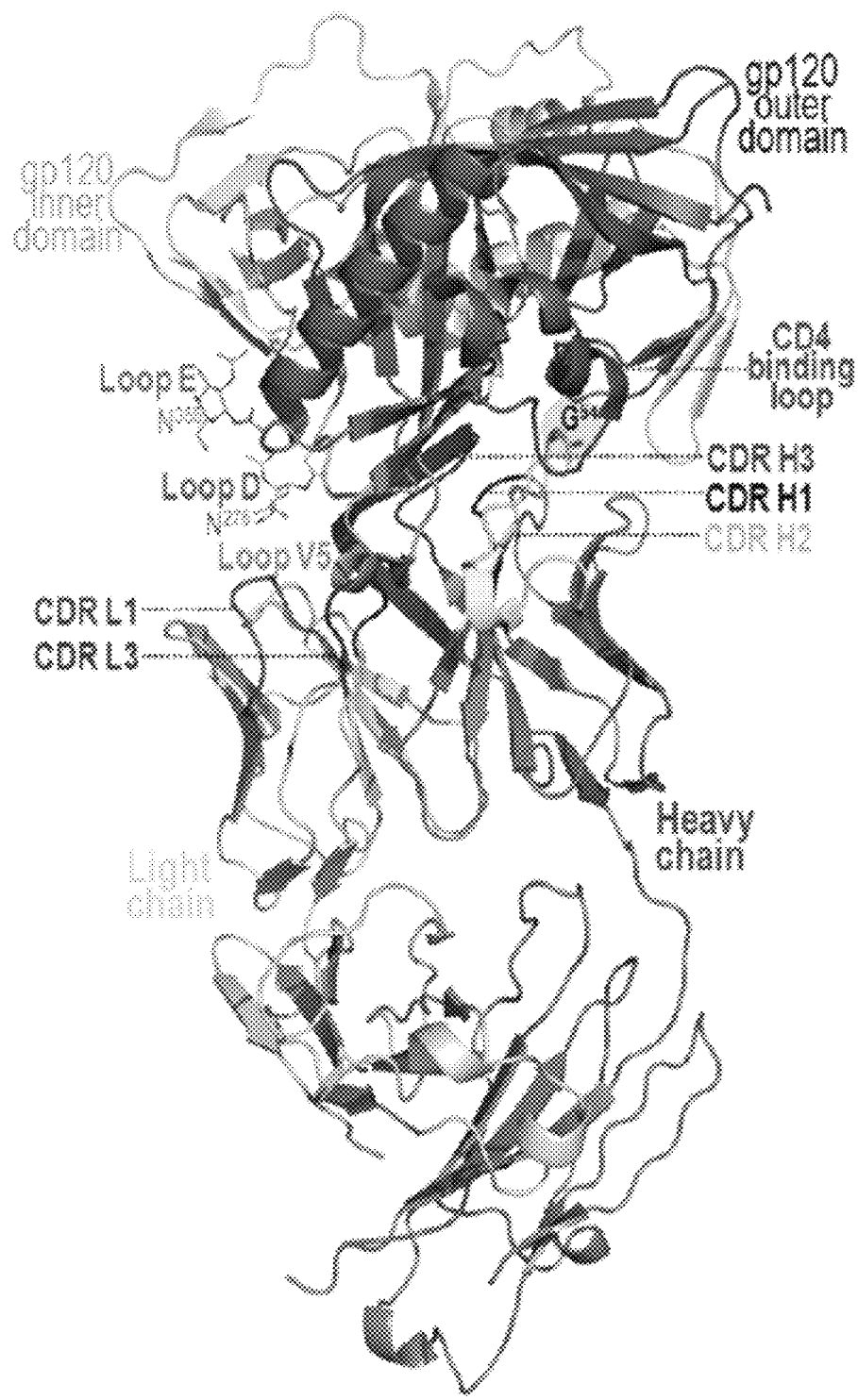
Figure 20B:
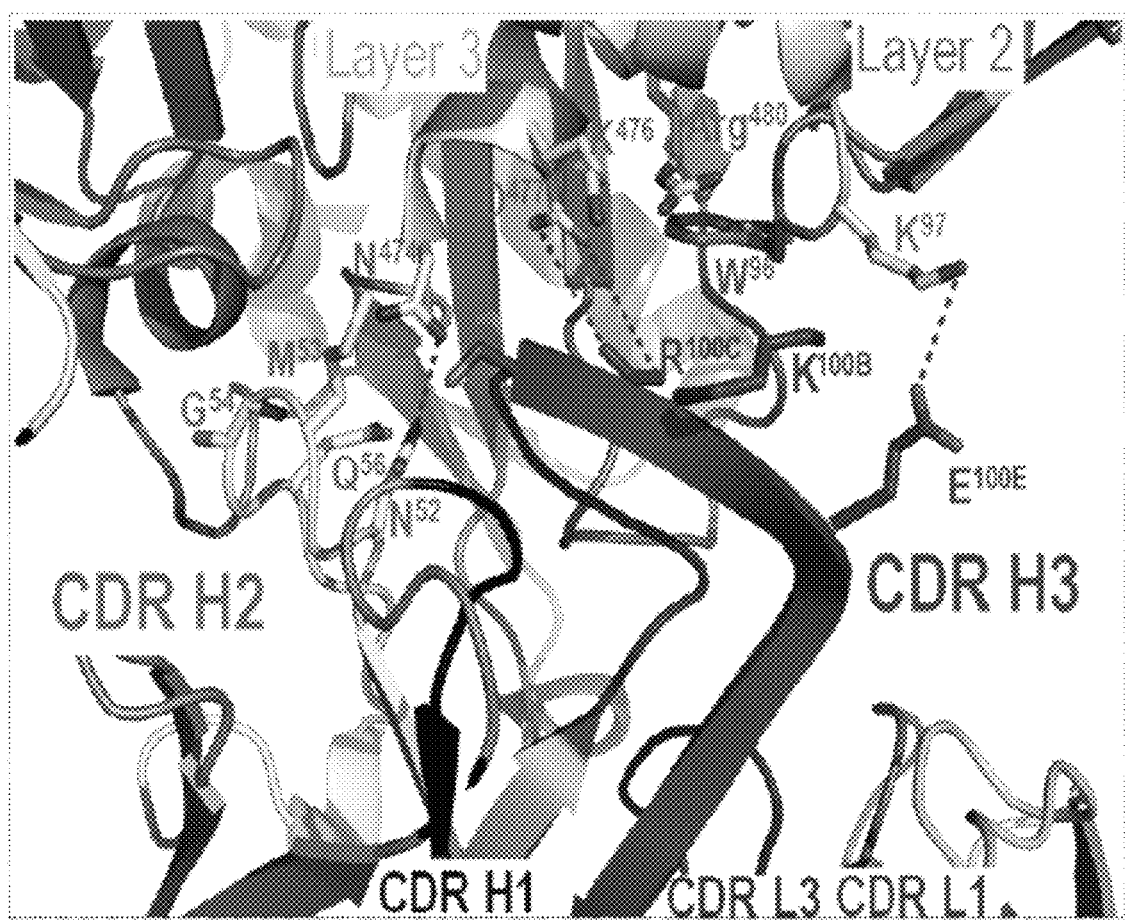
Figure 20C:
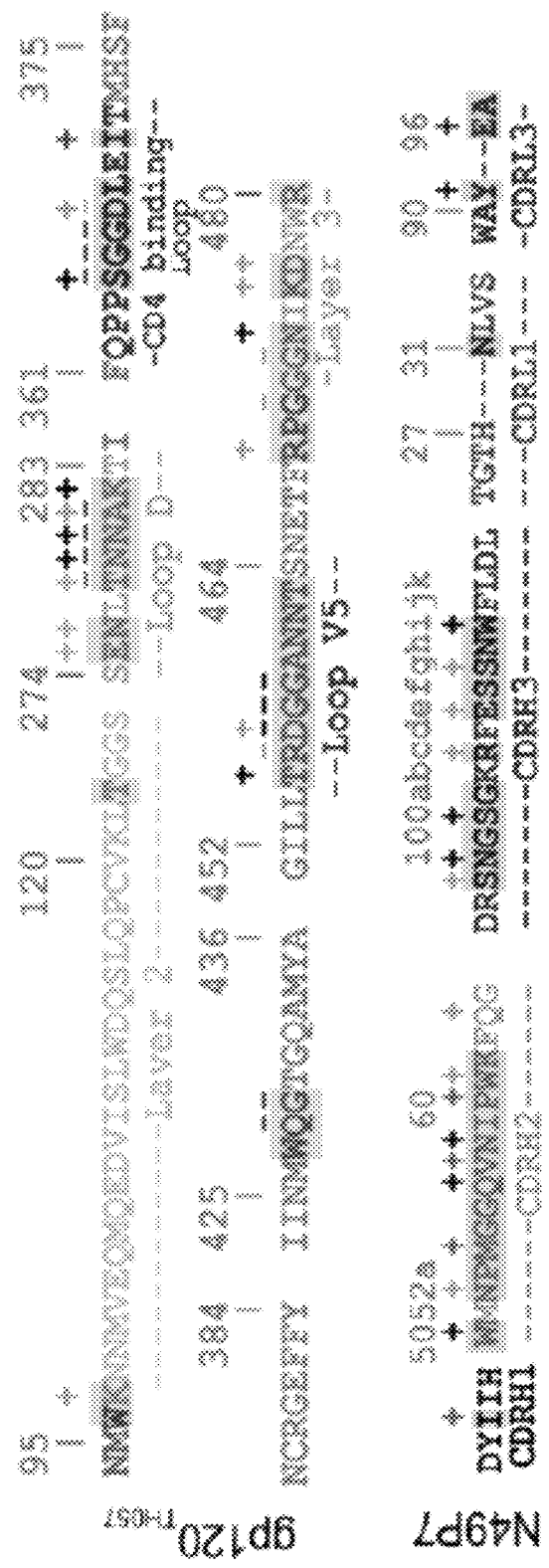
Figure 20D:
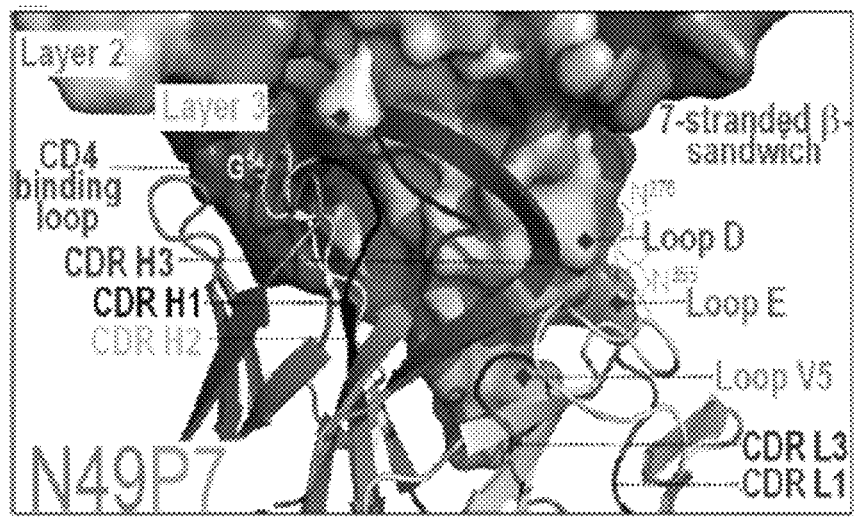
Figure 20D:
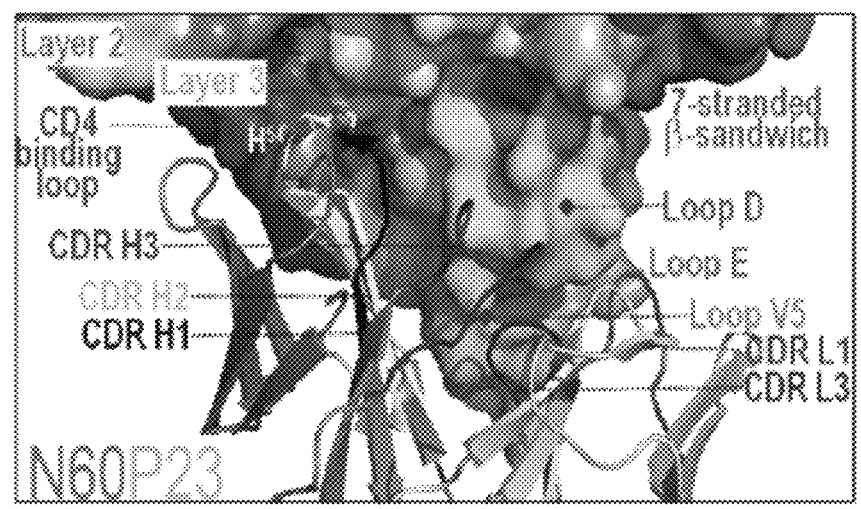
Figure 20D:
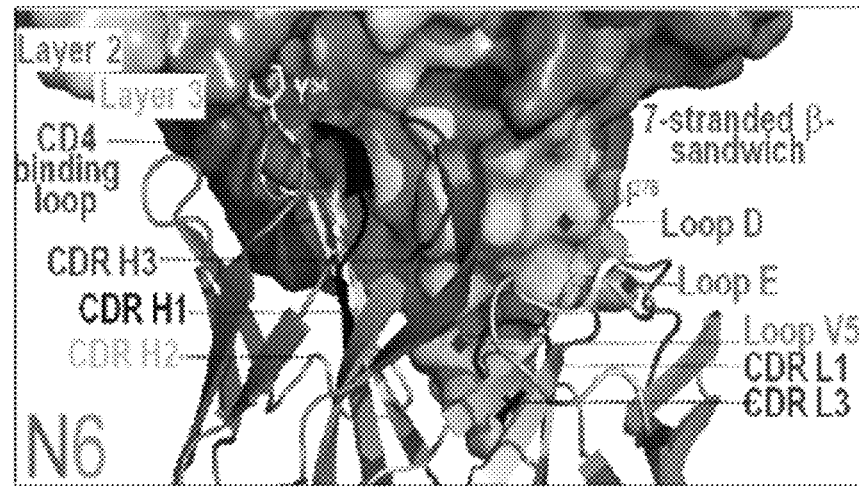
Figure 20E:
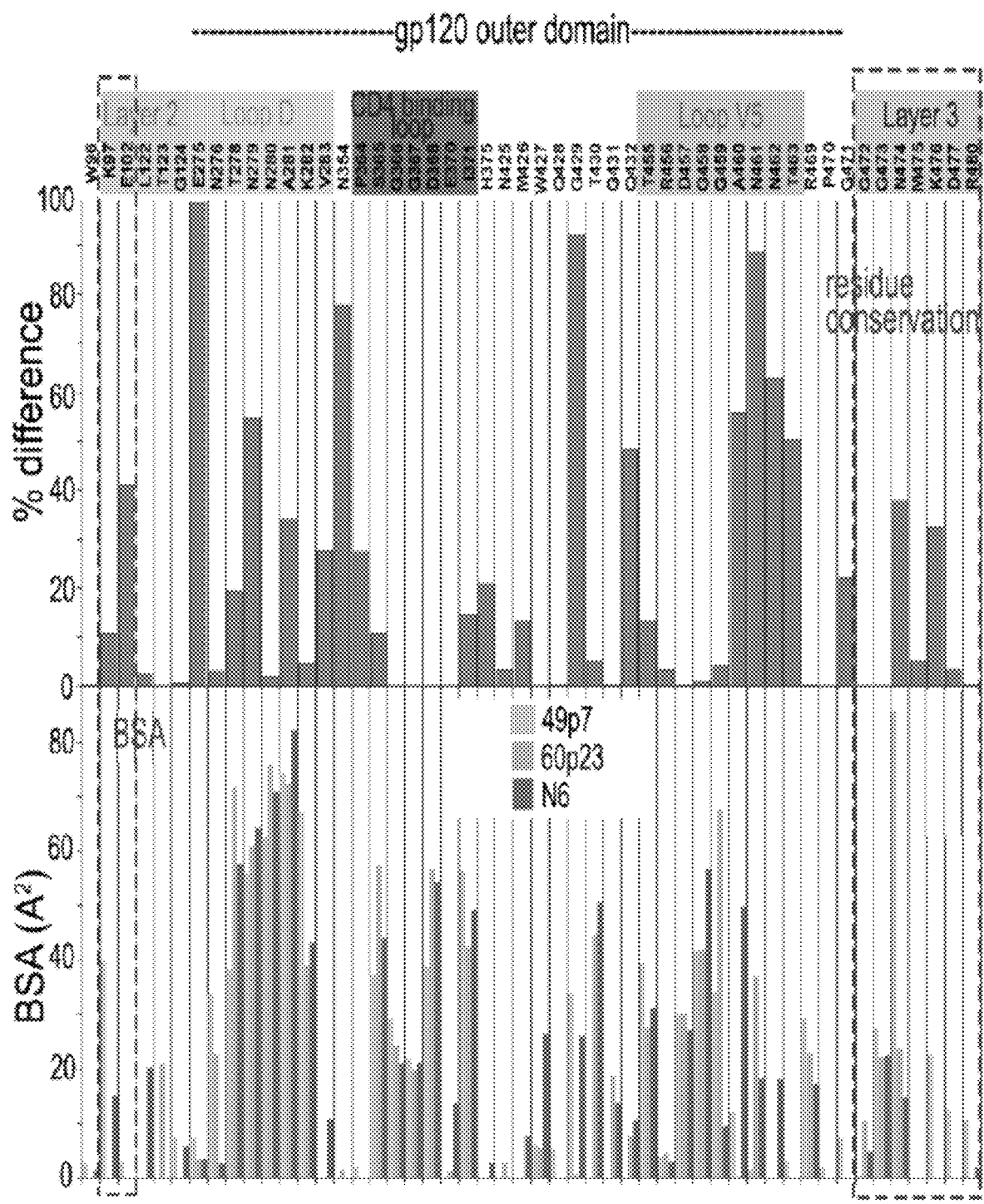

In some embodiments, the anti-HIV antibody binds to a HIV gp120 epitope comprising the specific residues as described in FIG. 20E. In some embodiments, the anti-HIV antibody binds to gp120 Layer 2 residues W96, K97, E102, G124, Loop D residues E275, N276, T278, N279, N280, A281, K282, CD4 binding loop residues P364, S365, G366, G367, D368, I371, bridging sheet residues W427, Q428, G429, Loop V5 residues T455, R456, D457, G458, G459, A460, N461, T463), and Layer 3 residues R469, P470, G471, G472, G473, N474, K476, D477, R480. In some embodiments, the anti-HIV antibody binding the aforementioned epitope is from the antibody lineage as shown in FIG. 15A. In some embodiments, the anti-HIV antibody is selected from N49P6 or an antigen binding fragment thereof, N49P7 or an antigen binding fragment thereof, N49P7.1 or an antigen binding fragment thereof, and N49P11 or an antigen binding fragment thereof. In some embodiments, the antibody comprises the VH and VL regions of N49P6, N49P7, N49P7.1 or N49P11 as described herein. In some embodiments, the antibody comprises the CDRs of the VH and VL regions of N49P6, N49P7, N49P7.1 or N49P11 as described herein. In some embodiments, the antibody has a Kd for BaL-gp120 of at least about $1.59 \times 10^{-8}$ M. In some embodiments, the antibody has a Kd for BaL-gp120 of at least about $1.562 \times 10^{-8}$ M. In some embodiments, the antibody has a Kd for BaL-gp120 of at least about $1.143 \times 10^{-9}$ M. In some embodiments, the antibody has a Kd for BaL-gp120 of at least about $8.602 \times 10^{-10}$ M. In some embodiments, the binding affinity is determined by surface plasmon resonance. See FIG. 10.

In some embodiments, the anti-HIV antibody binds to the same epitope as antibody N49P6, N49P7, N49P7.1, and/or N49P11.

In some embodiments, the anti-HIV antibody is an antibody that binds to the same epitope as an antibody selected from the group consisting of N49P6; N49P6.2; N49P7; N49P7.1; N49P7A; N49P7S; N49P7F; N49P7Y; N49P7-54TY; N49P7LS-1; N49P7LS-2; N49P7YTE; N49P7L6; N49P7L11; N49P7.1L9; N49P7.1L19; R49P7; N49P7.2; N49P11; N49P18; N49P18.2; N49P18.1; N49P19; N49P37; N49P38; N49P38.1; and N49P55.

In some embodiments, the anti-HIV antibody is an antibody that binds to the same epitope as antibody N49P7.

In some embodiments, the anti-HIV antibody is an antibody that binds to the same epitope as antibody N49P6.

In some embodiments, the anti-HIV antibody is an antibody that binds to the same epitope as antibody N49P7.1.

In some embodiments, the anti-HIV antibody is an antibody that binds to the same epitope as antibody N49P11.

In some embodiments, the anti-HIV antibody comprises a heavy chain comprising an amino acid sequence selected from the group consisting of SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73 and 75.

In some embodiments, the anti-HIV antibody comprises an antigen binding fragment of an amino acid sequence selected from the group consisting of SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73 and 75.

In some embodiments, the anti-HIV antibody comprises a light chain comprising an amino acid sequence selected from the group consisting of SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74 and 76.

In some embodiments, the anti-HIV antibody comprises an antigen binding fragment of an amino acid sequence selected from the group consisting of SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74 and 76.

In some embodiments, the anti-HIV antibody comprises a heavy chain comprising an amino acid sequence selected from the group consisting of SEQ ID NOS:153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 289, 293, 297, 301, 305, 309, 313, 317, 321, 325, 329, 333, 337, 341, 345, 349, 353, 357, 361, 365, 369, 373, 377, 381, 385, 389, 393 and 397.

In some embodiments, the anti-HIV antibody comprises an antigen binding fragment of an amino acid sequence selected from the group consisting of SEQ ID NOS:153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 289, 293, 297, 301, 305, 309, 313, 317, 321, 325, 329, 333, 337, 341, 345, 349, 353, 357, 361, 365, 369, 373, 377, 381, 385, 389, 393 and 397.

In some embodiments, the anti-HIV antibody comprises a light chain comprising an amino acid sequence selected from the group consisting of SEQ ID NOS:155, 159, 163, 167, 171, 175, 179, 183, 187, 191, 195, 199, 203, 207, 211, 215, 219, 223, 227, 231, 235, 239, 243, 247, 251, 255, 259, 263, 267, 271, 275, 279, 283, 287, 291, 295, 299, 303, 307, 311, 315, 319, 323, 327, 331, 335, 339, 343, 347, 351, 355, 359, 363, 367, 371, 375, 379, 383, 387, 391, 395 and 399.

In some embodiments, the anti-HIV antibody comprises an antigen binding fragment of an amino acid sequence selected from the group consisting of SEQ ID NOS:155, 159, 163, 167, 171, 175, 179, 183, 187, 191, 195, 199, 203, 207, 211, 215, 219, 223, 227, 231, 235, 239, 243, 247, 251, 255, 259, 263, 267, 271, 275, 279, 283, 287, 291, 295, 299, 303, 307, 311, 315, 319, 323, 327, 331, 335, 339, 343, 347, 351, 355, 359, 363, 367, 371, 375, 379, 383, 387, 391, 395 and 399.

In some embodiments, the anti-HIV antibody is selected from the group consisting of:
a. an antibody comprising a heavy chain amino acid sequence comprising SEQ ID NO:1 or an antigen binding fragment thereof and a light chain amino acid sequence comprising SEQ ID NO:2 or an antigen binding fragment thereof;
b. an antibody comprising a heavy chain amino acid sequence comprising SEQ ID NO:3 or an antigen binding fragment thereof and a light chain amino acid sequence comprising SEQ ID NO:4 or an antigen binding fragment thereof;
c. an antibody comprising a heavy chain amino acid sequence comprising SEQ ID NO:5 or an antigen binding fragment thereof and a light chain amino acid sequence comprising SEQ ID NO:6 or an antigen binding fragment thereof;
d. an antibody comprising a heavy chain amino acid sequence comprising SEQ ID NO:7 or an antigen binding fragment thereof and a light chain amino acid sequence comprising SEQ ID NO:8 or an antigen binding fragment thereof;
e. an antibody comprising a heavy chain amino acid sequence comprising SEQ ID NO:9 or an antigen binding fragment thereof and a light chain amino acid sequence comprising SEQ ID NO:10 or an antigen binding fragment thereof;
f. an antibody comprising a heavy chain amino acid sequence comprising SEQ ID NO:11 or an antigen binding fragment thereof and a light chain amino acid sequence comprising SEQ ID NO:12 or an antigen binding fragment thereof;
g. an antibody comprising a heavy chain amino acid sequence comprising SEQ ID NO:13 or an antigen binding fragment thereof and a light chain amino acid sequence comprising SEQ ID NO:14 or an antigen binding fragment thereof;
h. an antibody comprising a heavy chain amino acid sequence comprising SEQ ID NO:15 or an antigen binding fragment thereof and a light chain amino acid sequence comprising SEQ ID NO:16 or an antigen binding fragment thereof;
i. an antibody comprising a heavy chain amino acid sequence comprising SEQ ID NO:17 or an antigen binding fragment thereof and a light chain amino acid sequence comprising SEQ ID NO:18 or an antigen binding fragment thereof;
j. an antibody comprising a heavy chain amino acid sequence comprising SEQ ID NO:19 or an antigen binding fragment thereof and a light chain amino acid sequence comprising SEQ ID NO:20 or an antigen binding fragment thereof;
k. an antibody comprising a heavy chain amino acid sequence comprising SEQ ID NO:21 or an antigen binding fragment thereof and a light chain amino acid sequence comprising SEQ ID NO:22 or an antigen binding fragment thereof;
l. an antibody comprising a heavy chain amino acid sequence comprising SEQ ID NO:23 or an antigen binding fragment thereof and a light chain amino acid sequence comprising SEQ ID NO:24 or an antigen binding fragment thereof;
m. an antibody comprising a heavy chain amino acid sequence comprising SEQ ID NO:25 or an antigen binding fragment thereof and a light chain amino acid sequence comprising SEQ ID NO:26 or an antigen binding fragment thereof;
n. an antibody comprising a heavy chain amino acid sequence comprising SEQ ID NO:27 or an antigen binding fragment thereof and a light chain amino acid sequence comprising SEQ ID NO:28 or an antigen binding fragment thereof;
o. an antibody comprising a heavy chain amino acid sequence comprising SEQ ID NO:29 or an antigen binding fragment thereof and a light chain amino acid sequence comprising SEQ ID NO:30 or an antigen binding fragment thereof;
p. an antibody comprising a heavy chain amino acid sequence comprising SEQ ID NO:31 or an antigen binding fragment thereof and a light chain amino acid sequence comprising SEQ ID NO:32 or an antigen binding fragment thereof;
q. an antibody comprising a heavy chain amino acid sequence comprising SEQ ID NO:33 or an antigen binding fragment thereof and a light chain amino acid sequence comprising SEQ ID NO:34 or an antigen binding fragment thereof;
r. an antibody comprising a heavy chain amino acid sequence comprising SEQ ID NO:35 or an antigen binding fragment thereof and a light chain amino acid sequence comprising SEQ ID NO:36 or an antigen binding fragment thereof;
s. an antibody comprising a heavy chain amino acid sequence comprising SEQ ID NO:37 or an antigen binding fragment thereof and a light chain amino acid sequence comprising SEQ ID NO:38 or an antigen binding fragment thereof;
t. an antibody comprising a heavy chain amino acid sequence comprising SEQ ID NO:39 or an antigen binding fragment thereof and a light chain amino acid sequence comprising SEQ ID NO:40 or an antigen binding fragment thereof;
u. an antibody comprising a heavy chain amino acid sequence comprising SEQ ID NO:41 or an antigen binding fragment thereof and a light chain amino acid sequence comprising SEQ ID NO:42 or an antigen binding fragment thereof;
v. an antibody comprising a heavy chain amino acid sequence comprising SEQ ID NO:43 or an antigen binding fragment thereof and a light chain amino acid sequence comprising SEQ ID NO:44 or an antigen binding fragment thereof;
w. an antibody comprising a heavy chain amino acid sequence comprising SEQ ID NO:45 or an antigen binding fragment thereof and a light chain amino acid sequence comprising SEQ ID NO:46 or an antigen binding fragment thereof;
x. an antibody comprising a heavy chain amino acid sequence comprising SEQ ID NO:47 or an antigen binding fragment thereof and a light chain amino acid sequence comprising SEQ ID NO:48 or an antigen binding fragment thereof;
y. an antibody comprising a heavy chain amino acid sequence comprising SEQ ID NO:49 or an antigen binding fragment thereof and a light chain amino acid sequence comprising SEQ ID NO:50 or an antigen binding fragment thereof;
z. an antibody comprising a heavy chain amino acid sequence comprising SEQ ID NO:51 or an antigen binding fragment thereof and a light chain amino acid sequence comprising SEQ ID NO:52 or an antigen binding fragment thereof;
aa. an antibody comprising a heavy chain amino acid sequence comprising SEQ ID NO:53 or an antigen binding fragment thereof and a light chain amino acid sequence comprising SEQ ID NO:54 or an antigen binding fragment thereof;
bb. an antibody comprising a heavy chain amino acid sequence comprising SEQ ID NO:55 or an antigen binding fragment thereof and a light chain amino acid sequence comprising SEQ ID NO:56 or an antigen binding fragment thereof;
cc. an antibody comprising a heavy chain amino acid sequence comprising SEQ ID NO:57 or an antigen binding fragment thereof and a light chain amino acid sequence comprising SEQ ID NO:58 or an antigen binding fragment thereof;
dd. an antibody comprising a heavy chain amino acid sequence comprising SEQ ID NO:59 or an antigen binding fragment thereof and a light chain amino acid sequence comprising SEQ ID NO:60 or an antigen binding fragment thereof;
ee. an antibody comprising a heavy chain amino acid sequence comprising SEQ ID NO:61 or an antigen binding fragment thereof and a light chain amino acid sequence comprising SEQ ID NO:62 or an antigen binding fragment thereof;
ff. an antibody comprising a heavy chain amino acid sequence comprising SEQ ID NO:63 or an antigen binding fragment thereof and a light chain amino acid sequence comprising SEQ ID NO:64 or an antigen binding fragment thereof;
gg. an antibody comprising a heavy chain amino acid sequence comprising SEQ ID NO:65 or an antigen binding fragment thereof and a light chain amino acid sequence comprising SEQ ID NO:66 or an antigen binding fragment thereof;
hh. an antibody comprising a heavy chain amino acid sequence comprising SEQ ID NO:67 or an antigen binding fragment thereof and a light chain amino acid sequence comprising SEQ ID NO:68 or an antigen binding fragment thereof;
ii. an antibody comprising a heavy chain amino acid sequence comprising SEQ ID NO:69 or an antigen binding fragment thereof and a light chain amino acid sequence comprising SEQ ID NO:70 or an antigen binding fragment thereof;
jj. an antibody comprising a heavy chain amino acid sequence comprising SEQ ID NO:71 or an antigen binding fragment thereof and a light chain amino acid sequence comprising SEQ ID NO:72 or an antigen binding fragment thereof;
kk. an antibody comprising a heavy chain amino acid sequence comprising SEQ ID NO:73 or an antigen binding fragment thereof and a light chain amino acid sequence comprising SEQ ID NO:74 or an antigen binding fragment thereof;
ll. an antibody comprising a heavy chain amino acid sequence comprising SEQ ID NO:75 or an antigen binding fragment thereof and a light chain amino acid sequence comprising SEQ ID NO:76 or an antigen binding fragment thereof;
mm. an antibody comprising a heavy chain amino acid sequence comprising SEQ ID NO:153 or an antigen binding fragment thereof and a light chain amino acid sequence comprising SEQ ID NO:155 or an antigen binding fragment thereof;
nn. an antibody comprising a heavy chain amino acid sequence comprising SEQ ID NO:157 or an antigen binding fragment thereof and a light chain amino acid sequence comprising SEQ ID NO:159 or an antigen binding fragment thereof;
oo. an antibody comprising a heavy chain amino acid sequence comprising SEQ ID NO:161 or an antigen binding fragment thereof and a light chain amino acid sequence comprising SEQ ID NO:163 or an antigen binding fragment thereof;
pp. an antibody comprising a heavy chain amino acid sequence comprising SEQ ID NO:165 or an antigen binding fragment thereof and a light chain amino acid sequence comprising SEQ ID NO:167 or an antigen binding fragment thereof;
qq. an antibody comprising a heavy chain amino acid sequence comprising SEQ ID NO:169 or an antigen binding fragment thereof and a light chain amino acid sequence comprising SEQ ID NO:171 or an antigen binding fragment thereof;
rr. an antibody comprising a heavy chain amino acid sequence comprising SEQ ID NO:173 or an antigen binding fragment thereof and a light chain amino acid sequence comprising SEQ ID NO:175 or an antigen binding fragment thereof;
ss. an antibody comprising a heavy chain amino acid sequence comprising SEQ ID NO:177 or an antigen binding fragment thereof and a light chain amino acid sequence comprising SEQ ID NO:179 or an antigen binding fragment thereof;
tt. an antibody comprising a heavy chain amino acid sequence comprising SEQ ID NO:181 or an antigen binding fragment thereof and a light chain amino acid sequence comprising SEQ ID NO:183 or an antigen binding fragment thereof;
uu. an antibody comprising a heavy chain amino acid sequence comprising SEQ ID NO:185 or an antigen binding fragment thereof and a light chain amino acid sequence comprising SEQ ID NO:187 or an antigen binding fragment thereof;

vv. an antibody comprising a heavy chain amino acid sequence comprising SEQ ID NO:189 or an antigen binding fragment thereof and a light chain amino acid sequence comprising SEQ ID NO:191 or an antigen binding fragment thereof;

ww. an antibody comprising a heavy chain amino acid sequence comprising SEQ ID NO:193 or an antigen binding fragment thereof and a light chain amino acid sequence comprising SEQ ID NO:195 or an antigen binding fragment thereof;

xx. an antibody comprising a heavy chain amino acid sequence comprising SEQ ID NO:197 or an antigen binding fragment thereof and a light chain amino acid sequence comprising SEQ ID NO:199 or an antigen binding fragment thereof;

yy. an antibody comprising a heavy chain amino acid sequence comprising SEQ ID NO:201 or an antigen binding fragment thereof and a light chain amino acid sequence comprising SEQ ID NO:203 or an antigen binding fragment thereof;

zz. an antibody comprising a heavy chain amino acid sequence comprising SEQ ID NO:205 or an antigen binding fragment thereof and a light chain amino acid sequence comprising SEQ ID NO:207 or an antigen binding fragment thereof;

aaa. an antibody comprising a heavy chain amino acid sequence comprising SEQ ID NO:209 or an antigen binding fragment thereof and a light chain amino acid sequence comprising SEQ ID NO:211 or an antigen binding fragment thereof;

bbb. an antibody comprising a heavy chain amino acid sequence comprising SEQ ID NO:213 or an antigen binding fragment thereof and a light chain amino acid sequence comprising SEQ ID NO:215 or an antigen binding fragment thereof;

ccc. an antibody comprising a heavy chain amino acid sequence comprising SEQ ID NO:217 or an antigen binding fragment thereof and a light chain amino acid sequence comprising SEQ ID NO:219 or an antigen binding fragment thereof;

ddd. an antibody comprising a heavy chain amino acid sequence comprising SEQ ID NO:221 or an antigen binding fragment thereof and a light chain amino acid sequence comprising SEQ ID NO:223 or an antigen binding fragment thereof;

eee. an antibody comprising a heavy chain amino acid sequence comprising SEQ ID NO:225 or an antigen binding fragment thereof and a light chain amino acid sequence comprising SEQ ID NO:227 or an antigen binding fragment thereof;

fff. an antibody comprising a heavy chain amino acid sequence comprising SEQ ID NO:229 or an antigen binding fragment thereof and a light chain amino acid sequence comprising SEQ ID NO:231 or an antigen binding fragment thereof;

ggg. an antibody comprising a heavy chain amino acid sequence comprising SEQ ID NO:233 or an antigen binding fragment thereof and a light chain amino acid sequence comprising SEQ ID NO:235 or an antigen binding fragment thereof;

hhh. an antibody comprising a heavy chain amino acid sequence comprising SEQ ID NO:237 or an antigen binding fragment thereof and a light chain amino acid sequence comprising SEQ ID NO:239 or an antigen binding fragment thereof;

iii. an antibody comprising a heavy chain amino acid sequence comprising SEQ ID NO:241 or an antigen binding fragment thereof and a light chain amino acid sequence comprising SEQ ID NO:243 or an antigen binding fragment thereof;

jjj. an antibody comprising a heavy chain amino acid sequence comprising SEQ ID NO:245 or an antigen binding fragment thereof and a light chain amino acid sequence comprising SEQ ID NO:247 or an antigen binding fragment thereof;

kkk. an antibody comprising a heavy chain amino acid sequence comprising SEQ ID NO:249 or an antigen binding fragment thereof and a light chain amino acid sequence comprising SEQ ID NO:251 or an antigen binding fragment thereof;

lll. an antibody comprising a heavy chain amino acid sequence comprising SEQ ID NO:253 or an antigen binding fragment thereof and a light chain amino acid sequence comprising SEQ ID NO:255 or an antigen binding fragment thereof;

mmm. an antibody comprising a heavy chain amino acid sequence comprising SEQ ID NO:257 or an antigen binding fragment thereof and a light chain amino acid sequence comprising SEQ ID NO:259 or an antigen binding fragment thereof;

nnn. an antibody comprising a heavy chain amino acid sequence comprising SEQ ID NO:261 or an antigen binding fragment thereof and a light chain amino acid sequence comprising SEQ ID NO:263 or an antigen binding fragment thereof;

ooo. an antibody comprising a heavy chain amino acid sequence comprising SEQ ID NO:265 or an antigen binding fragment thereof and a light chain amino acid sequence comprising SEQ ID NO:267 or an antigen binding fragment thereof;

ppp. an antibody comprising a heavy chain amino acid sequence comprising SEQ ID NO:269 or an antigen binding fragment thereof and a light chain amino acid sequence comprising SEQ ID NO:271 or an antigen binding fragment thereof;

qqq. an antibody comprising a heavy chain amino acid sequence comprising SEQ ID NO:273 or an antigen binding fragment thereof and a light chain amino acid sequence comprising SEQ ID NO:275 or an antigen binding fragment thereof;

rrr. an antibody comprising a heavy chain amino acid sequence comprising SEQ ID NO:277 or an antigen binding fragment thereof and a light chain amino acid sequence comprising SEQ ID NO:279 or an antigen binding fragment thereof;

sss. an antibody comprising a heavy chain amino acid sequence comprising SEQ ID NO:281 or an antigen binding fragment thereof and a light chain amino acid sequence comprising SEQ ID NO:283 or an antigen binding fragment thereof;

ttt. an antibody comprising a heavy chain amino acid sequence comprising SEQ ID NO:285 or an antigen binding fragment thereof and a light chain amino acid sequence comprising SEQ ID NO:287 or an antigen binding fragment thereof;

uuu. an antibody comprising a heavy chain amino acid sequence comprising SEQ ID NO:289 or an antigen binding fragment thereof and a light chain amino acid sequence comprising SEQ ID NO:291 or an antigen binding fragment thereof;

vvv. an antibody comprising a heavy chain amino acid sequence comprising SEQ ID NO:293 or an antigen binding fragment thereof and a light chain amino acid sequence comprising SEQ ID NO:295 or an antigen binding fragment thereof;

www. an antibody comprising a heavy chain amino acid sequence comprising SEQ ID NO:297 or an antigen binding fragment thereof and a light chain amino acid sequence comprising SEQ ID NO:299 or an antigen binding fragment thereof;

xxx. an antibody comprising a heavy chain amino acid sequence comprising SEQ ID NO:301 or an antigen binding fragment thereof and a light chain amino acid sequence comprising SEQ ID NO:303 or an antigen binding fragment thereof;

yyy. an antibody comprising a heavy chain amino acid sequence comprising SEQ ID NO:305 or an antigen binding fragment thereof and a light chain amino acid sequence comprising SEQ ID NO:307 or an antigen binding fragment thereof;

zzz. an antibody comprising a heavy chain amino acid sequence comprising SEQ ID NO:309 or an antigen binding fragment thereof and a light chain amino acid sequence comprising SEQ ID NO:311 or an antigen binding fragment thereof;

aaaa. an antibody comprising a heavy chain amino acid sequence comprising SEQ ID NO:313 or an antigen binding fragment thereof and a light chain amino acid sequence comprising SEQ ID NO:315 or an antigen binding fragment thereof;

bbbb. an antibody comprising a heavy chain amino acid sequence comprising SEQ ID NO:317 or an antigen binding fragment thereof and a light chain amino acid sequence comprising SEQ ID NO:319 or an antigen binding fragment thereof;

cccc. an antibody comprising a heavy chain amino acid sequence comprising SEQ ID NO:321 or an antigen binding fragment thereof and a light chain amino acid sequence comprising SEQ ID NO:323 or an antigen binding fragment thereof;

dddd. an antibody comprising a heavy chain amino acid sequence comprising SEQ ID NO:325 or an antigen binding fragment thereof and a light chain amino acid sequence comprising SEQ ID NO:327 or an antigen binding fragment thereof;

eeee. an antibody comprising a heavy chain amino acid sequence comprising SEQ ID NO:329 or an antigen binding fragment thereof and a light chain amino acid sequence comprising SEQ ID NO:331 or an antigen binding fragment thereof;

ffff. an antibody comprising a heavy chain amino acid sequence comprising SEQ ID NO:333 or an antigen binding fragment thereof and a light chain amino acid sequence comprising SEQ ID NO:335 or an antigen binding fragment thereof;

gggg. an antibody comprising a heavy chain amino acid sequence comprising SEQ ID NO:337 or an antigen binding fragment thereof and a light chain amino acid sequence comprising SEQ ID NO:339 or an antigen binding fragment thereof;

hhhh. an antibody comprising a heavy chain amino acid sequence comprising SEQ ID NO:341 or an antigen binding fragment thereof and a light chain amino acid sequence comprising SEQ ID NO:343 or an antigen binding fragment thereof;

iiii. an antibody comprising a heavy chain amino acid sequence comprising SEQ ID NO:345 or an antigen binding fragment thereof and a light chain amino acid sequence comprising SEQ ID NO:347 or an antigen binding fragment thereof;

jjjj. an antibody comprising a heavy chain amino acid sequence comprising SEQ ID NO:349 or an antigen binding fragment thereof and a light chain amino acid sequence comprising SEQ ID NO:351 or an antigen binding fragment thereof;

kkkk an antibody comprising a heavy chain amino acid sequence comprising SEQ ID NO:353 or an antigen binding fragment thereof and a light chain amino acid sequence comprising SEQ ID NO:355 or an antigen binding fragment thereof;

llll. an antibody comprising a heavy chain amino acid sequence comprising SEQ ID NO:357 or an antigen binding fragment thereof and a light chain amino acid sequence comprising SEQ ID NO:359 or an antigen binding fragment thereof;

mmmm. an antibody comprising a heavy chain amino acid sequence comprising SEQ ID NO:361 or an antigen binding fragment thereof and a light chain amino acid sequence comprising SEQ ID NO:363 or an antigen binding fragment thereof;

nnnn. an antibody comprising a heavy chain amino acid sequence comprising SEQ ID NO:365 or an antigen binding fragment thereof and a light chain amino acid sequence comprising SEQ ID NO:367 or an antigen binding fragment thereof;

oooo. an antibody comprising a heavy chain amino acid sequence comprising SEQ ID NO:369 or an antigen binding fragment thereof and a light chain amino acid sequence comprising SEQ ID NO:371 or an antigen binding fragment thereof;

pppp. an antibody comprising a heavy chain amino acid sequence comprising SEQ ID NO:373 or an antigen binding fragment thereof and a light chain amino acid sequence comprising SEQ ID NO:375 or an antigen binding fragment thereof;

qqqq. an antibody comprising a heavy chain amino acid sequence comprising SEQ ID NO:377 or an antigen binding fragment thereof and a light chain amino acid sequence comprising SEQ ID NO:379 or an antigen binding fragment thereof;

rrrr. an antibody comprising a heavy chain amino acid sequence comprising SEQ ID NO:381 or an antigen binding fragment thereof and a light chain amino acid sequence comprising SEQ ID NO:383 or an antigen binding fragment thereof;

ssss. an antibody comprising a heavy chain amino acid sequence comprising SEQ ID NO:385 or an antigen binding fragment thereof and a light chain amino acid sequence comprising SEQ ID NO:387 or an antigen binding fragment thereof;

tttt. an antibody comprising a heavy chain amino acid sequence comprising SEQ ID NO:389 or an antigen binding fragment thereof and a light chain amino acid sequence comprising SEQ ID NO:391 or an antigen binding fragment thereof;

uuuu. an antibody comprising a heavy chain amino acid sequence comprising SEQ ID NO:393 or an antigen binding fragment thereof and a light chain amino acid sequence comprising SEQ ID NO:395 or an antigen binding fragment thereof; and vvvv. an antibody comprising a heavy chain amino acid sequence comprising SEQ ID NO:397 or an antigen binding fragment thereof and a light chain amino acid sequence comprising SEQ ID NO:399 or an antigen binding fragment thereof.

In some embodiments, the anti-HIV antibody is isolated and/or substantially pure.

In some embodiments, the anti-HIV antibody comprises a heavy chain or an antigen binding fragment thereof and a light chain or an antigen binding fragment thereof, wherein the heavy chain comprises a heavy chain variable (VH) region and the light chain comprises a light chain variable (VL) region; wherein the VL region comprises one or more VL complementary determining regions (CDRs) and wherein the VH region comprises one or more VH complementary determining regions (CDRs), wherein the VL CDRs correspond to the CDRs found within any of SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 155, 159, 163, 167, 171, 175, 179, 183, 187, 191, 195, 199, 203, 207, 211, 215, 219, 223, 227, 231, 235, 239, 243, 247, 251, 255, 259, 263, 267, 271, 275, 279, 283, 287, 291, 295, 299, 303, 307, 311, 315, 319, 323, 327, 331, 335, 339, 343, 347, 351, 355, 359, 363, 367, 371, 375, 379, 383, 387, 391, 395 and 399.

In some embodiments, the anti-HIV antibody comprises a heavy chain or an antigen binding fragment thereof and a light chain or an antigen binding fragment thereof, wherein the heavy chain comprises a heavy chain variable (VH) region and the light chain comprises a light chain variable (VL) region; wherein the VL region comprises one or more VL complementary determining regions (CDRs) and wherein the VH region comprises one or more VH complementary determining regions (CDRs), wherein the VH CDRs correspond to the CDRs found within any of SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 289, 293, 297, 301, 305, 309, 313, 317, 321, 325, 329, 333, 337, 341, 345, 349, 353, 357, 361, 365, 369, 373, 377, 381, 385, 389, 393 and 397.

In some embodiments, the anti-HIV antibody comprises a heavy chain or an antigen binding fragment thereof and a light chain or an antigen binding fragment thereof, wherein the heavy chain comprises a heavy chain variable (VH) region and the light chain comprises a light chain variable (VL) region; wherein the VL region comprises one or more VL complementary determining regions (CDRs) and wherein the VH region comprises one or more VH complementary determining regions (CDRs), wherein the VL CDRs correspond to the CDRs found within any of SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 155, 159, 163, 167, 171, 175, 179, 183, 187, 191, 195, 199, 203, 207, 211, 215, 219, 223, 227, 231, 235, 239, 243, 247, 251, 255, 259, 263, 267, 271, 275, 279, 283, 287, 291, 295, 299, 303, 307, 311, 315, 319, 323, 327, 331, 335, 339, 343, 347, 351, 355, 359, 363, 367, 371, 375, 379, 383, 387, 391, 395 and 399 or a variant thereof comprising 1, 2, 3, or 4 conservative amino acid substitutions, and wherein the VH CDRs correspond to the CDRs found within any of SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 289, 293, 297, 301, 305, 309, 313, 317, 321, 325, 329, 333, 337, 341, 345, 349, 353, 357, 361, 365, 369, 373, 377, 381, 385, 389, 393 and 397 or a variant thereof comprising 1, 2, 3, or 4 conservative amino acid substitutions.

In some embodiments, the anti-HIV antibody comprises a heavy chain or an antigen binding fragment thereof and a light chain or an antigen binding fragment thereof, wherein the heavy chain comprises a heavy chain variable (VH) region and the light chain comprises a light chain variable (VL) region; wherein the VL region comprises an amino acid sequence selected from the group consisting of: amino acids 1-99 of SEQ ID NO:2; amino acids 1-99 of SEQ ID NO:4; amino acids 1-99 of SEQ ID NO:6; amino acids 1-99 of SEQ ID NO:8; amino acids 1-99 of SEQ ID NO:10; amino acids 1-99 of SEQ ID NO:12; amino acids 1-99 of SEQ ID NO:14; amino acids 1-99 of SEQ ID NO:16; amino acids 1-99 of SEQ ID NO:18; amino acids 1-99 of SEQ ID NO:20; amino acids 1-99 of SEQ ID NO:22; amino acids 1-99 of SEQ ID NO:24; amino acids 1-99 of SEQ ID NO:26; amino acids 1-99 of SEQ ID NO:28; amino acids 1-99 of SEQ ID NO:30; amino acids 1-99 of SEQ ID NO:32; amino acids 1-99 of SEQ ID NO:34; amino acids 1-100 of SEQ ID NO:36; amino acids 1-97 of SEQ ID NO:38; amino acids 1-100 of SEQ ID NO:40; amino acids 1-100 of SEQ ID NO:42; amino acids 1-97 of SEQ ID NO:44; amino acids 1-101 of SEQ ID NO:46; amino acids 1-101 of SEQ ID NO:48; amino acids 1-96 of SEQ ID NO:50; amino acids 1-97 of SEQ ID NO:52; amino acids 1-99 of SEQ ID NO:54; amino acids 1-99 of SEQ ID NO:56; amino acids 1-99 of SEQ ID NO:58; amino acids 1-99 of SEQ ID NO:60; amino acids 1-98 of SEQ ID NO:62; amino acids 1-99 of SEQ ID NO:64; amino acids 1-99 of SEQ ID NO:66; amino acids 1-96 of SEQ ID NO:68; amino acids 1-96 of SEQ ID NO:70; amino acids 1-96 of SEQ ID NO:72; amino acids 1-101 of SEQ ID NO:74; amino acids 1-97 of SEQ ID NO:76; amino acids 1-99 of SEQ ID NO:155; amino acids 1-99 of SEQ ID NO:159; amino acids 1-99 of SEQ ID NO:163; amino acids 1-99 of SEQ ID NO:167; amino acids 1-99 of SEQ ID NO:171; amino acids 1-99 of SEQ ID NO:175; amino acids 1-99 of SEQ ID NO:179; amino acids 1-99 of SEQ ID NO:183; amino acids 1-99 of SEQ ID NO:187; amino acids 1-99 of SEQ ID NO:191; amino acids 1-99 of SEQ ID NO:195; amino acids 1-99 of SEQ ID NO:199; amino acids 1-99 of SEQ ID NO:203; amino acids 1-99 of SEQ ID NO:207; amino acids 1-100 of SEQ ID NO:211; amino acids 1-99 of SEQ ID NO:215; amino acids 1-99 of SEQ ID NO:219; amino acids 1-99 of SEQ ID NO:223; amino acids 1-99 of SEQ ID NO:227; amino acids 1-99 of SEQ ID NO:231; amino acids 1-99 of SEQ ID NO:235; amino acids 1-99 of SEQ ID NO:239; amino acids 1-99 of SEQ ID NO:243; amino acids 1-99 of SEQ ID NO:247; amino acids 1-99 of SEQ ID NO:251; amino acids 1-99 of SEQ ID NO:255; amino acids 1-99 of SEQ ID NO:259; amino acids 1-99 of SEQ ID NO:263; amino acids 1-99 of SEQ ID NO:267; amino acids 1-99 of SEQ ID NO:271; amino acids 1-99 of SEQ ID NO:275; amino acids 1-99 of SEQ ID NO:279; amino acids 1-99 of SEQ ID NO:283; amino acids 1-99 of SEQ ID NO:287; amino acids 1-99 of SEQ ID NO:291; amino acids 1-100 of SEQ ID NO:295; amino acids 1-100 of SEQ ID NO:299; amino acids 1-100 of SEQ ID NO:303; amino acids 1-100 of SEQ ID NO:307; amino acids 1-100 of SEQ ID NO:311; amino acids 1-100 of SEQ ID NO:315; amino acids 1-97 of SEQ ID NO:319; amino acids 1-100 of SEQ ID NO:323; amino acids 1-100 of SEQ ID NO:327; amino acids 1-100 of SEQ ID NO:331; amino acids 1-97 of SEQ ID NO:335; amino acids 1-101 of SEQ ID NO:339; amino acids 1-101 of SEQ ID NO:343; amino acids 1-96 of SEQ ID NO:347; amino acids 1-97 of SEQ ID NO:351; amino acids 1-99 of SEQ ID NO:355; amino acids 1-99 of SEQ ID NO:359; amino acids 1-99 of SEQ ID NO:363; amino acids 1-99 of SEQ ID NO:367; amino acids 1-98 of SEQ ID NO:371; amino acids 1-99 of SEQ ID NO:375; amino acids 1-99 of SEQ ID NO:379; amino acids 1-96 of SEQ ID NO:383; amino acids 1-96 of SEQ ID NO:387; amino acids 1-96 of SEQ ID NO:391; amino acids 1-101 of SEQ ID NO:395; and amino acids 1-97 of SEQ ID NO:399 or a variant thereof comprising 1, 2, 3, or 4 conservative amino acid substitutions.

In some embodiments, the anti-HIV antibody comprises a heavy chain or an antigen binding fragment thereof and a light chain or an antigen binding fragment thereof, wherein the heavy chain comprises a heavy chain variable (VH) region and the light chain comprises a light chain variable (VL) region; wherein the VH region comprises an amino acid sequence selected from the group consisting of: amino acids 1-128 of SEQ ID NO:1; amino acids 1-127 of SEQ ID NO:3; amino acids 1-127 of SEQ ID NO:5; amino acids 1-128 of SEQ ID NO:7; amino acids 1-127 of SEQ ID NO:9; amino acids 1-127 of SEQ ID NO:11; amino acids 1-127 of SEQ ID NO:13; amino acids 1-127 of SEQ ID NO:15; amino acids 1-127 of SEQ ID NO:17; amino acids 1-127 of SEQ ID NO:19; amino acids 1-127 of SEQ ID NO:21; amino acids 1-127 of SEQ ID NO:23; amino acids 1-127 of SEQ ID NO:25; amino acids 1-127 of SEQ ID NO:27; amino acids 1-127 of SEQ ID NO:29; amino acids 1-127 of SEQ ID NO:31; amino acids 1-127 of SEQ ID NO:33; amino acids 1-120 of SEQ ID NO:35; amino acids 1-120 of SEQ ID NO:37; amino acids 1-123 of SEQ ID NO:39; amino acids 1-120 of SEQ ID NO:41; amino acids 1-120 of SEQ ID NO:43; amino acids 1-125 of SEQ ID NO:45; amino acids 1-125 of SEQ ID NO:47; amino acids 1-120 of SEQ ID NO:49; amino acids 1-120 of SEQ ID NO:51; amino acids 1-121 of SEQ ID NO:53; amino acids 1-121 of SEQ ID NO:55; amino acids 1-121 of SEQ ID NO:57; amino acids 1-121 of SEQ ID NO:59; amino acids 1-120 of SEQ ID NO:61; amino acids 1-121 of SEQ ID NO:63; amino acids 1-121 of SEQ ID NO:65; amino acids 1-120 of SEQ ID NO:67; amino acids 1-120 of SEQ ID NO:69; amino acids 1-120 of SEQ ID NO:71; amino acids 1-125 of SEQ ID NO:73; amino acids 1-120 of SEQ ID NO:75; amino acids 1-128 of SEQ ID NO:153; amino acids 1-128 of SEQ ID NO:157; amino acids 1-127 of SEQ ID NO:161; amino acids 1-127 of SEQ ID NO:165; amino acids 1-127 of SEQ ID NO:169; amino acids 1-127 of SEQ ID NO:173; amino acids 1-127 of SEQ ID NO:177; amino acids 1-127 of SEQ ID NO:181; amino acids 1-127 of SEQ ID NO:185; amino acids 1-127 of SEQ ID NO:189; amino acids 1-127 of SEQ ID NO:193; amino acids 1-127 of SEQ ID NO:197; amino acids 1-127 of SEQ ID NO:201; amino acids 1-127 of SEQ ID NO:205; amino acids 1-127 of SEQ ID NO:209; amino acids 1-127 of SEQ ID NO:213; amino acids 1-127 of SEQ ID NO:217; amino acids 1-127 of SEQ ID NO:221; amino acids 1-128 of SEQ ID NO:225; amino acids 1-127 of SEQ ID NO:229; amino acids 1-127 of SEQ ID NO:233; amino acids 1-127 of SEQ ID NO:237; amino acids 1-127 of SEQ ID NO:241; amino acids 1-127 of SEQ ID NO:245; amino acids 1-127 of SEQ ID NO:249; amino acids 1-127 of SEQ ID NO:253; amino acids 1-127 of SEQ ID NO:257; amino acids 1-127 of SEQ ID NO:261; amino acids 1-127 of SEQ ID NO:265; amino acids 1-127 of SEQ ID NO:269; amino acids 1-127 of SEQ ID NO:273; amino acids 1-127 of SEQ ID NO:277; amino acids 1-127 of SEQ ID NO:281; amino acids 1-127 of SEQ ID NO:285; amino acids 1-127 of SEQ ID NO:289; amino acids 1-120 of SEQ ID NO:293; amino acids 1-120 of SEQ ID NO:297; amino acids 1-120 of SEQ ID NO:301; amino acids 1-123 of SEQ ID NO:305; amino acids 1-128 of SEQ ID NO:309; amino acids 1-128 of SEQ ID NO:313; amino acids 1-120 of SEQ ID NO:317; amino acids 1-123 of SEQ ID NO:321; amino acids 1-120 of SEQ ID NO:325; amino acids 1-120 of SEQ ID NO:329; amino acids 1-120 of SEQ ID NO:333; amino acids 1-125 of SEQ ID NO:337; amino acids 1-125 of SEQ ID NO:341; amino acids 1-120 of SEQ ID NO:345; amino acids 1-120 of SEQ ID NO:349; amino acids 1-121 of SEQ ID NO:353; amino acids 1-121 of SEQ ID NO:357; amino acids 1-121 of SEQ ID NO:361; amino acids 1-121 of SEQ ID NO:365; amino acids 1-120 of SEQ ID NO:369; amino acids 1-121 of SEQ ID NO:373; amino acids 1-121 of SEQ ID NO:377; amino acids 1-120 of SEQ ID NO:381; amino acids 1-120 of SEQ ID NO:385; amino acids 1-120 of SEQ ID NO:389; amino acids 1-125 of SEQ ID NO:393; and amino acids 1-120 of SEQ ID NO:397 or a variant thereof comprising 1, 2, 3, or 4 conservative amino acid substitutions.

In some embodiments, the anti-HIV antibody comprises a heavy chain or an antigen binding fragment thereof and a light chain or an antigen binding fragment thereof, wherein the heavy chain or antigen binding fragment thereof comprises a heavy chain variable (VH) region and the light chain or antigen binding fragment thereof comprises a light chain variable (VL) region; wherein the anti-HIV antibody is selected from the group consisting of an antibody:

i) wherein the VH region comprises amino acids 1-128 of SEQ ID NO:1 or a variant thereof comprising 1, 2, 3, or 4 conservative amino acid substitutions; wherein the VL region comprises amino acids 1-99 of SEQ ID NO:2 or a variant thereof comprising 1, 2, 3, or 4 conservative amino acid substitutions;

ii) wherein the VH region comprises amino acids 1-127 of SEQ ID NO:3 or a variant thereof comprising 1, 2, 3, or 4 conservative amino acid substitutions; wherein the VL region comprises amino acids 1-99 of SEQ ID NO:4 or a variant thereof comprising 1, 2, 3, or 4 conservative amino acid substitutions;

iii) wherein the VH region comprises amino acids 1-127 of SEQ ID NO:5 or a variant thereof comprising 1, 2, 3, or 4 conservative amino acid substitutions; wherein the VL region comprises amino acids 1-99 of SEQ ID NO:6 or a variant thereof comprising 1, 2, 3, or 4 conservative amino acid substitutions;

iv) wherein the VH region comprises amino acids 1-128 of SEQ ID NO:7 or a variant thereof comprising 1, 2, 3, or 4 conservative amino acid substitutions; wherein the VL region comprises amino acids 1-99 of SEQ ID NO:8 or a variant thereof comprising 1, 2, 3, or 4 conservative amino acid substitutions;

v) wherein the VH region comprises amino acids 1-127 of SEQ ID NO:9 or a variant thereof comprising 1, 2, 3, or 4 conservative amino acid substitutions; wherein the VL region comprises amino acids 1-99 of SEQ ID NO:10 or a variant thereof comprising 1, 2, 3, or 4 conservative amino acid substitutions;

vi) wherein the VH region comprises amino acids 1-127 of SEQ ID NO:11 or a variant thereof comprising 1, 2, 3, or 4 conservative amino acid substitutions; wherein the VL region comprises amino acids 1-99 of SEQ ID NO:12 or a variant thereof comprising 1, 2, 3, or 4 conservative amino acid substitutions;

vii) wherein the VH region comprises amino acids 1-127 of SEQ ID NO:13 or a variant thereof comprising 1, 2, 3, or 4 conservative amino acid substitutions; wherein the VL region comprises amino acids 1-99 of SEQ ID NO:14 or a variant thereof comprising 1, 2, 3, or 4 conservative amino acid substitutions;

viii) wherein the VH region comprises amino acids 1-127 of SEQ ID NO:15 or a variant thereof comprising 1, 2, 3, or 4 conservative amino acid substitutions; wherein the VL region comprises amino acids 1-99 of SEQ ID NO:16 or a variant thereof comprising 1, 2, 3, or 4 conservative amino acid substitutions;

ix) wherein the VH region comprises amino acids 1-127 of SEQ ID NO:17 or a variant thereof comprising 1, 2, 3, or 4 conservative amino acid substitutions; wherein the VL region comprises amino acids 1-99 of SEQ ID NO:18 or a variant thereof comprising 1, 2, 3, or 4 conservative amino acid substitutions;

x) wherein the VH region comprises amino acids 1-127 of SEQ ID NO:19 or a variant thereof comprising 1, 2, 3, or 4 conservative amino acid substitutions; wherein the VL region comprises amino acids 1-99 of SEQ ID NO:20 or a variant thereof comprising 1, 2, 3, or 4 conservative amino acid substitutions;

xi) wherein the VH region comprises amino acids 1-127 of SEQ ID NO:21 or a variant thereof comprising 1, 2, 3, or 4 conservative amino acid substitutions; wherein the VL region comprises amino acids 1-99 of SEQ ID NO:22 or a variant thereof comprising 1, 2, 3, or 4 conservative amino acid substitutions;

xii) wherein the VH region comprises amino acids 1-127 of SEQ ID NO:23 or a variant thereof comprising 1, 2, 3, or 4 conservative amino acid substitutions; wherein the VL region comprises amino acids 1-99 of SEQ ID NO:24 or a variant thereof comprising 1, 2, 3, or 4 conservative amino acid substitutions;

xiii) wherein the VH region comprises amino acids 1-127 of SEQ ID NO:25 or a variant thereof comprising 1, 2, 3, or 4 conservative amino acid substitutions; wherein the VL region comprises amino acids 1-99 of SEQ ID NO:26 or a variant thereof comprising 1, 2, 3, or 4 conservative amino acid substitutions;

xiv) wherein the VH region comprises amino acids 1-127 of SEQ ID NO:27 or a variant thereof comprising 1, 2, 3, or 4 conservative amino acid substitutions; wherein the VL region comprises amino acids 1-99 of SEQ ID NO:28 or a variant thereof comprising 1, 2, 3, or 4 conservative amino acid substitutions;

xv) wherein the VH region comprises amino acids 1-127 of SEQ ID NO:29 or a variant thereof comprising 1, 2, 3, or 4 conservative amino acid substitutions; wherein the VL region comprises amino acids 1-99 of SEQ ID NO:30 or a variant thereof comprising 1, 2, 3, or 4 conservative amino acid substitutions;

xvi) wherein the VH region comprises amino acids 1-127 of SEQ ID NO:31 or a variant thereof comprising 1, 2, 3, or 4 conservative amino acid substitutions; wherein the VL region comprises amino acids 1-99 of SEQ ID NO:32 or a variant thereof comprising 1, 2, 3, or 4 conservative amino acid substitutions;

xvii) wherein the VH region comprises amino acids 1-127 of SEQ ID NO:33 or a variant thereof comprising 1, 2, 3, or 4 conservative amino acid substitutions; wherein the VL region comprises amino acids 1-99 of SEQ ID NO:34 or a variant thereof comprising 1, 2, 3, or 4 conservative amino acid substitutions;

xviii) wherein the VH region comprises amino acids 1-120 of SEQ ID NO:35 or a variant thereof comprising 1, 2, 3, or 4 conservative amino acid substitutions; wherein the VL region comprises amino acids 1-100 of SEQ ID NO:36 or a variant thereof comprising 1, 2, 3, or 4 conservative amino acid substitutions;

xix) wherein the VH region comprises amino acids 1-120 of SEQ ID NO:37 or a variant thereof comprising 1, 2, 3, or 4 conservative amino acid substitutions; wherein the VL region comprises amino acids 1-97 of SEQ ID NO:38 or a variant thereof comprising 1, 2, 3, or 4 conservative amino acid substitutions;

xx) wherein the VH region comprises amino acids 1-123 of SEQ ID NO:39 or a variant thereof comprising 1, 2, 3, or 4 conservative amino acid substitutions; wherein the VL region comprises amino acids 1-100 of SEQ ID NO:40 or a variant thereof comprising 1, 2, 3, or 4 conservative amino acid substitutions;

xxi) wherein the VH region comprises amino acids 1-120 of SEQ ID NO:41 or a variant thereof comprising 1, 2, 3, or 4 conservative amino acid substitutions; wherein the VL region comprises amino acids 1-100 of SEQ ID NO:42 or a variant thereof comprising 1, 2, 3, or 4 conservative amino acid substitutions;

xxii) wherein the VH region comprises amino acids 1-120 of SEQ ID NO:43 or a variant thereof comprising 1, 2, 3, or 4 conservative amino acid substitutions; wherein the VL region comprises amino acids 1-97 of SEQ ID NO:44 or a variant thereof comprising 1, 2, 3, or 4 conservative amino acid substitutions;

xxiii) wherein the VH region comprises amino acids 1-125 of SEQ ID NO:45 or a variant thereof comprising 1, 2, 3, or 4 conservative amino acid substitutions; wherein the VL region comprises amino acids 1-101 of SEQ ID NO:46 or a variant thereof comprising 1, 2, 3, or 4 conservative amino acid substitutions;

xxiv) wherein the VH region comprises amino acids 1-125 of SEQ ID NO:47 or a variant thereof comprising 1, 2, 3, or 4 conservative amino acid substitutions; wherein the VL region comprises amino acids 1-101 of SEQ ID NO:48 or a variant thereof comprising 1, 2, 3, or 4 conservative amino acid substitutions;

xxv) wherein the VH region comprises amino acids 1-120 of SEQ ID NO:49 or a variant thereof comprising 1, 2, 3, or 4 conservative amino acid substitutions; wherein the VL region comprises amino acids 1-96 of SEQ ID NO:50 or a variant thereof comprising 1, 2, 3, or 4 conservative amino acid substitutions;

xxvi) wherein the VH region comprises amino acids 1-120 of SEQ ID NO:51 or a variant thereof comprising 1, 2, 3, or 4 conservative amino acid substitutions; wherein the VL region comprises amino acids 1-97 of SEQ ID NO:52 or a variant thereof comprising 1, 2, 3, or 4 conservative amino acid substitutions;

xxvii) wherein the VH region comprises amino acids 1-121 of SEQ ID NO:53 or a variant thereof comprising 1, 2, 3, or 4 conservative amino acid substitutions; wherein the VL region comprises amino acids 1-99 of SEQ ID NO:54 or a variant thereof comprising 1, 2, 3, or 4 conservative amino acid substitutions;

xxviii) wherein the VH region comprises amino acids 1-121 of SEQ ID NO:55 or a variant thereof comprising 1, 2, 3, or 4 conservative amino acid substitutions; wherein the VL region comprises amino acids 1-99 of SEQ ID NO:56 or a variant thereof comprising 1, 2, 3, or 4 conservative amino acid substitutions;

xxix) wherein the VH region comprises amino acids 1-121 of SEQ ID NO:57 or a variant thereof comprising 1, 2, 3, or 4 conservative amino acid substitutions; wherein the VL region comprises amino acids 1-99 of SEQ ID NO:58 or a variant thereof comprising 1, 2, 3, or 4 conservative amino acid substitutions;

xxx) wherein the VH region comprises amino acids 1-121 of SEQ ID NO:59 or a variant thereof comprising 1, 2, 3, or 4 conservative amino acid substitutions; wherein the VL region comprises amino acids 1-99 of SEQ ID NO:60 or a variant thereof comprising 1, 2, 3, or 4 conservative amino acid substitutions;

xxxi) wherein the VH region comprises amino acids 1-120 of SEQ ID NO:61 or a variant thereof comprising 1, 2, 3, or 4 conservative amino acid substitutions; wherein the VL region comprises amino acids 1-98 of SEQ ID NO:62 or a variant thereof comprising 1, 2, 3, or 4 conservative amino acid substitutions;

xxxii) wherein the VH region comprises amino acids 1-121 of SEQ ID NO:63 or a variant thereof comprising 1, 2, 3, or 4 conservative amino acid substitutions; wherein the VL region comprises amino acids 1-99 of SEQ ID NO:64 or a variant thereof comprising 1, 2, 3, or 4 conservative amino acid substitutions;

xxxiii) wherein the VH region comprises amino acids 1-121 of SEQ ID NO:65 or a variant thereof comprising 1, 2, 3, or 4 conservative amino acid substitutions; wherein the VL region comprises amino acids 1-99 of SEQ ID NO:66 or a variant thereof comprising 1, 2, 3, or 4 conservative amino acid substitutions;

xxxiv) wherein the VH region comprises amino acids 1-120 of SEQ ID NO:67 or a variant thereof comprising 1, 2, 3, or 4 conservative amino acid substitutions; wherein the VL region comprises amino acids 1-96 of SEQ ID NO:68 or a variant thereof comprising 1, 2, 3, or 4 conservative amino acid substitutions;

xxxv) wherein the VH region comprises amino acids 1-120 of SEQ ID NO:69 or a variant thereof comprising 1, 2, 3, or 4 conservative amino acid substitutions; wherein the VL region comprises amino acids 1-96 of SEQ ID NO:70 or a variant thereof comprising 1, 2, 3, or 4 conservative amino acid substitutions;

xxxvi) wherein the VH region comprises amino acids 1-120 of SEQ ID NO:71 or a variant thereof comprising 1, 2, 3, or 4 conservative amino acid substitutions; wherein the VL region comprises amino acids 1-96 of SEQ ID NO:72 or a variant thereof comprising 1, 2, 3, or 4 conservative amino acid substitutions;

xxxvii) wherein the VH region comprises amino acids 1-125 of SEQ ID NO:73 or a variant thereof comprising 1, 2, 3, or 4 conservative amino acid substitutions; wherein the VL region comprises amino acids 1-101 of SEQ ID NO:74 or a variant thereof comprising 1, 2, 3, or 4 conservative amino acid substitutions;

xxxviii) wherein the VH region comprises amino acids 1-120 of SEQ ID NO:75 or a variant thereof comprising 1, 2, 3, or 4 conservative amino acid substitutions; wherein the VL region comprises amino acids 1-97 of SEQ ID NO:76 or a variant thereof comprising 1, 2, 3, or 4 conservative amino acid substitutions;

xxxix) wherein the VH region comprises amino acids 1-128 of SEQ ID NO:153 or a variant thereof comprising 1, 2, 3, or 4 conservative amino acid substitutions; wherein the VL region comprises amino acids 1-99 of SEQ ID NO:155 or a variant thereof comprising 1, 2, 3, or 4 conservative amino acid substitutions;

xl) wherein the VH region comprises amino acids 1-128 of SEQ ID NO:157 or a variant thereof comprising 1, 2, 3, or 4 conservative amino acid substitutions; wherein the VL region comprises amino acids 1-99 of SEQ ID NO:159 or a variant thereof comprising 1, 2, 3, or 4 conservative amino acid substitutions;

xli) wherein the VH region comprises amino acids 1-127 of SEQ ID NO:161 or a variant thereof comprising 1, 2, 3, or 4 conservative amino acid substitutions; wherein the VL region comprises amino acids 1-99 of SEQ ID NO:163 or a variant thereof comprising 1, 2, 3, or 4 conservative amino acid substitutions;

xlii) wherein the VH region comprises amino acids 1-127 of SEQ ID NO:165 or a variant thereof comprising 1, 2, 3, or 4 conservative amino acid substitutions; wherein the VL region comprises amino acids 1-99 of SEQ ID NO:167 or a variant thereof comprising 1, 2, 3, or 4 conservative amino acid substitutions;

xliii) wherein the VH region comprises amino acids 1-127 of SEQ ID NO:169 or a variant thereof comprising 1, 2, 3, or 4 conservative amino acid substitutions; wherein the VL region comprises amino acids 1-99 of SEQ ID NO:171 or a variant thereof comprising 1, 2, 3, or 4 conservative amino acid substitutions;

xliv) wherein the VH region comprises amino acids 1-127 of SEQ ID NO:173 or a variant thereof comprising 1, 2, 3, or 4 conservative amino acid substitutions; wherein the VL region comprises amino acids 1-99 of SEQ ID NO:175 or a variant thereof comprising 1, 2, 3, or 4 conservative amino acid substitutions;

xlv) wherein the VH region comprises amino acids 1-127 of SEQ ID NO:177 or a variant thereof comprising 1, 2, 3, or 4 conservative amino acid substitutions; wherein the VL region comprises amino acids 1-99 of SEQ ID NO:179 or a variant thereof comprising 1, 2, 3, or 4 conservative amino acid substitutions;

xlvi) wherein the VH region comprises amino acids 1-127 of SEQ ID NO:181 or a variant thereof comprising 1, 2, 3, or 4 conservative amino acid substitutions; wherein the VL region comprises amino acids 1-99 of SEQ ID NO:183 or a variant thereof comprising 1, 2, 3, or 4 conservative amino acid substitutions;

xlvii) wherein the VH region comprises amino acids 1-127 of SEQ ID NO:185 or a variant thereof comprising 1, 2, 3, or 4 conservative amino acid substitutions; wherein the VL region comprises amino acids 1-99 of SEQ ID NO:187 or a variant thereof comprising 1, 2, 3, or 4 conservative amino acid substitutions;

xlviii) wherein the VH region comprises amino acids 1-127 of SEQ ID NO:189 or a variant thereof comprising 1, 2, 3, or 4 conservative amino acid substitutions; wherein the VL region comprises amino acids 1-99 of SEQ ID NO:191 or a variant thereof comprising 1, 2, 3, or 4 conservative amino acid substitutions;

xlix) wherein the VH region comprises amino acids 1-127 of SEQ ID NO:193 or a variant thereof comprising 1, 2, 3, or 4 conservative amino acid substitutions; wherein the VL region comprises amino acids 1-99 of SEQ ID NO:195 or a variant thereof comprising 1, 2, 3, or 4 conservative amino acid substitutions;

l) wherein the VH region comprises amino acids 1-127 of SEQ ID NO:197 or a variant thereof comprising 1, 2, 3, or 4 conservative amino acid substitutions; wherein the VL region comprises amino acids 1-99 of SEQ ID NO:199 or a variant thereof comprising 1, 2, 3, or 4 conservative amino acid substitutions;

li) wherein the VH region comprises amino acids 1-127 of SEQ ID NO:201 or a variant thereof comprising 1, 2, 3, or 4 conservative amino acid substitutions; wherein the VL region comprises amino acids 1-99 of SEQ ID NO:203 or a variant thereof comprising 1, 2, 3, or 4 conservative amino acid substitutions;

lii) wherein the VH region comprises amino acids 1-127 of SEQ ID NO:205 or a variant thereof comprising 1, 2, 3, or 4 conservative amino acid substitutions; wherein the VL region comprises amino acids 1-99 of SEQ ID NO:207 or a variant thereof comprising 1, 2, 3, or 4 conservative amino acid substitutions;

liii) wherein the VH region comprises amino acids 1-127 of SEQ ID NO:209 or a variant thereof comprising 1, 2, 3, or 4 conservative amino acid substitutions; wherein the VL region comprises amino acids 1-100 of SEQ ID NO:211 or a variant thereof comprising 1, 2, 3, or 4 conservative amino acid substitutions;

liv) wherein the VH region comprises amino acids 1-127 of SEQ ID NO:213 or a variant thereof comprising 1, 2, 3, or 4 conservative amino acid substitutions; wherein the VL region comprises amino acids 1-99 of SEQ ID NO:215 or a variant thereof comprising 1, 2, 3, or 4 conservative amino acid substitutions; wherein the VH region comprises amino acids 1-127 of SEQ ID NO:217 or a variant thereof comprising 1, 2, 3, or 4 conservative amino acid substitutions; wherein the VL region comprises amino acids 1-99 of SEQ ID NO:219 or a variant thereof comprising 1, 2, 3, or 4 conservative amino acid substitutions;

lv) wherein the VH region comprises amino acids 1-127 of SEQ ID NO:221 or a variant thereof comprising 1, 2, 3, or 4 conservative amino acid substitutions; wherein the VL region comprises amino acids 1-99 of SEQ ID NO:223 or a variant thereof comprising 1, 2, 3, or 4 conservative amino acid substitutions;

lvi) wherein the VH region comprises amino acids 1-128 of SEQ ID NO:225 or a variant thereof comprising 1, 2, 3, or 4 conservative amino acid substitutions; wherein the VL region comprises amino acids 1-99 of SEQ ID NO:227 or a variant thereof comprising 1, 2, 3, or 4 conservative amino acid substitutions;

lvii) wherein the VH region comprises amino acids 1-127 of SEQ ID NO:229 or a variant thereof comprising 1, 2, 3, or 4 conservative amino acid substitutions; wherein the VL region comprises amino acids 1-99 of SEQ ID NO:231 or a variant thereof comprising 1, 2, 3, or 4 conservative amino acid substitutions;

lviii) wherein the VH region comprises amino acids 1-127 of SEQ ID NO:233 or a variant thereof comprising 1, 2, 3, or 4 conservative amino acid substitutions; wherein the VL region comprises amino acids 1-99 of SEQ ID NO:235 or a variant thereof comprising 1, 2, 3, or 4 conservative amino acid substitutions;

lix) wherein the VH region comprises amino acids 1-127 of SEQ ID NO:237 or a variant thereof comprising 1, 2, 3, or 4 conservative amino acid substitutions; wherein the VL region comprises amino acids 1-99 of SEQ ID NO:239 or a variant thereof comprising 1, 2, 3, or 4 conservative amino acid substitutions;

lx) wherein the VH region comprises amino acids 1-127 of SEQ ID NO:241 or a variant thereof comprising 1, 2, 3, or 4 conservative amino acid substitutions; wherein the VL region comprises amino acids 1-99 of SEQ ID NO:243 or a variant thereof comprising 1, 2, 3, or 4 conservative amino acid substitutions;

lxi) wherein the VH region comprises amino acids 1-127 of SEQ ID NO:245 or a variant thereof comprising 1, 2, 3, or 4 conservative amino acid substitutions; wherein the VL region comprises amino acids 1-99 of SEQ ID NO:247 or a variant thereof comprising 1, 2, 3, or 4 conservative amino acid substitutions;

lxii) wherein the VH region comprises amino acids 1-127 of SEQ ID NO:249 or a variant thereof comprising 1, 2, 3, or 4 conservative amino acid substitutions; wherein the VL region comprises amino acids 1-99 of SEQ ID NO:251 or a variant thereof comprising 1, 2, 3, or 4 conservative amino acid substitutions;

lxiii) wherein the VH region comprises amino acids 1-127 of SEQ ID NO:253 or a variant thereof comprising 1, 2, 3, or 4 conservative amino acid substitutions; wherein the VL region comprises amino acids 1-99 of SEQ ID NO:255 or a variant thereof comprising 1, 2, 3, or 4 conservative amino acid substitutions;

lxiv) wherein the VH region comprises amino acids 1-127 of SEQ ID NO:257 or a variant thereof comprising 1, 2, 3, or 4 conservative amino acid substitutions; wherein the VL region comprises amino acids 1-99 of SEQ ID NO:259 or a variant thereof comprising 1, 2, 3, or 4 conservative amino acid substitutions;

lxv) wherein the VH region comprises amino acids 1-127 of SEQ ID NO:261 or a variant thereof comprising 1, 2, 3, or 4 conservative amino acid substitutions; wherein the VL region comprises amino acids 1-99 of SEQ ID NO:263 or a variant thereof comprising 1, 2, 3, or 4 conservative amino acid substitutions;

lxvi) wherein the VH region comprises amino acids 1-127 of SEQ ID NO:265 or a variant thereof comprising 1, 2, 3, or 4 conservative amino acid substitutions; wherein the VL region comprises amino acids 1-99 of SEQ ID NO:267 or a variant thereof comprising 1, 2, 3, or 4 conservative amino acid substitutions;

lxvii) wherein the VH region comprises amino acids 1-127 of SEQ ID NO:269 or a variant thereof comprising 1, 2, 3, or 4 conservative amino acid substitutions; wherein the VL region comprises amino acids 1-99 of SEQ ID NO:271 or a variant thereof comprising 1, 2, 3, or 4 conservative amino acid substitutions;

lxviii) wherein the VH region comprises amino acids 1-127 of SEQ ID NO:273 or a variant thereof comprising 1, 2, 3, or 4 conservative amino acid substitutions; wherein the VL region comprises amino acids 1-99 of SEQ ID NO:275 or a variant thereof comprising 1, 2, 3, or 4 conservative amino acid substitutions;

lxix) wherein the VH region comprises amino acids 1-127 of SEQ ID NO:277 or a variant thereof comprising 1, 2, 3, or 4 conservative amino acid substitutions; wherein the VL region comprises amino acids 1-99 of SEQ ID NO:279 or a variant thereof comprising 1, 2, 3, or 4 conservative amino acid substitutions;

lxx) wherein the VH region comprises amino acids 1-127 of SEQ ID NO:281 or a variant thereof comprising 1, 2, 3, or 4 conservative amino acid substitutions; wherein the VL region comprises amino acids 1-99 of SEQ ID NO:283 or a variant thereof comprising 1, 2, 3, or 4 conservative amino acid substitutions;

lxxi) wherein the VH region comprises amino acids 1-127 of SEQ ID NO:285 or a variant thereof comprising 1, 2, 3, or 4 conservative amino acid substitutions; wherein the VL region comprises amino acids 1-99 of SEQ ID NO:287 or a variant thereof comprising 1, 2, 3, or 4 conservative amino acid substitutions;

lxxii) wherein the VH region comprises amino acids 1-127 of SEQ ID NO:289 or a variant thereof comprising 1, 2, 3, or 4 conservative amino acid substitutions; wherein the VL region comprises amino acids 1-99 of SEQ ID NO:291 or a variant thereof comprising 1, 2, 3, or 4 conservative amino acid substitutions;

lxxiii) wherein the VH region comprises amino acids 1-120 of SEQ ID NO:293 or a variant thereof comprising 1, 2, 3, or 4 conservative amino acid substitutions; wherein the VL region comprises amino acids 1-100 of SEQ ID NO:295 or a variant thereof comprising 1, 2, 3, or 4 conservative amino acid substitutions;

lxxiv) wherein the VH region comprises amino acids 1-120 of SEQ ID NO:297 or a variant thereof comprising 1, 2, 3, or 4 conservative amino acid substitutions; wherein the VL region comprises amino acids 1-100 of SEQ ID NO:299 or a variant thereof comprising 1, 2, 3, or 4 conservative amino acid substitutions;

lxxv) wherein the VH region comprises amino acids 1-120 of SEQ ID NO:301 or a variant thereof comprising 1, 2, 3, or 4 conservative amino acid substitutions; wherein the VL region comprises amino acids 1-100 of SEQ ID NO:303 or a variant thereof comprising 1, 2, 3, or 4 conservative amino acid substitutions;

lxxvi) wherein the VH region comprises amino acids 1-123 of SEQ ID NO:305 or a variant thereof comprising 1, 2, 3, or 4 conservative amino acid substitutions; wherein the VL region comprises amino acids 1-100 of SEQ ID NO:307 or a variant thereof comprising 1, 2, 3, or 4 conservative amino acid substitutions;

lxxvii) wherein the VH region comprises amino acids 1-128 of SEQ ID NO:309 or a variant thereof comprising 1, 2, 3, or 4 conservative amino acid substitutions; wherein the VL region comprises amino acids 1-100 of SEQ ID NO:311 or a variant thereof comprising 1, 2, 3, or 4 conservative amino acid substitutions;

lxxviii) wherein the VH region comprises amino acids 1-128 of SEQ ID NO:313 or a variant thereof comprising 1, 2, 3, or 4 conservative amino acid substitutions; wherein the VL region comprises amino acids 1-100 of SEQ ID NO:315 or a variant thereof comprising 1, 2, 3, or 4 conservative amino acid substitutions;

lxxix) wherein the VH region comprises amino acids 1-120 of SEQ ID NO:317 or a variant thereof comprising 1, 2, 3, or 4 conservative amino acid substitutions; wherein the VL region comprises amino acids 1-97 of SEQ ID NO:319 or a variant thereof comprising 1, 2, 3, or 4 conservative amino acid substitutions;

lxxx) wherein the VH region comprises amino acids 1-123 of SEQ ID NO:321 or a variant thereof comprising 1, 2, 3, or 4 conservative amino acid substitutions; wherein the VL region comprises amino acids 1-100 of SEQ ID NO:323 or a variant thereof comprising 1, 2, 3, or 4 conservative amino acid substitutions;

lxxxi) wherein the VH region comprises amino acids 1-120 of SEQ ID NO:325 or a variant thereof comprising 1, 2, 3, or 4 conservative amino acid substitutions; wherein the VL region comprises amino acids 1-100 of SEQ ID NO:327 or a variant thereof comprising 1, 2, 3, or 4 conservative amino acid substitutions;

lxxxii) wherein the VH region comprises amino acids 1-120 of SEQ ID NO:329 or a variant thereof comprising 1, 2, 3, or 4 conservative amino acid substitutions; wherein the VL region comprises amino acids 1-100 of SEQ ID NO:331 or a variant thereof comprising 1, 2, 3, or 4 conservative amino acid substitutions;

lxxxiii) wherein the VH region comprises amino acids 1-120 of SEQ ID NO:333 or a variant thereof comprising 1, 2, 3, or 4 conservative amino acid substitutions; wherein the VL region comprises amino acids 1-97 of SEQ ID NO:335 or a variant thereof comprising 1, 2, 3, or 4 conservative amino acid substitutions;

lxxxiv) wherein the VH region comprises amino acids 1-125 of SEQ ID NO:337 or a variant thereof comprising 1, 2, 3, or 4 conservative amino acid substitutions; wherein the VL region comprises amino acids 1-101 of SEQ ID NO:339 or a variant thereof comprising 1, 2, 3, or 4 conservative amino acid substitutions;

lxxxv) wherein the VH region comprises amino acids 1-125 of SEQ ID NO:341 or a variant thereof comprising 1, 2, 3, or 4 conservative amino acid substitutions; wherein the VL region comprises amino acids 1-101 of SEQ ID NO:343 or a variant thereof comprising 1, 2, 3, or 4 conservative amino acid substitutions;

lxxxvi) wherein the VH region comprises amino acids 1-120 of SEQ ID NO:345 or a variant thereof comprising 1, 2, 3, or 4 conservative amino acid substitutions; wherein the VL region comprises amino acids 1-96 of SEQ ID NO:347 or a variant thereof comprising 1, 2, 3, or 4 conservative amino acid substitutions;

lxxxvii) wherein the VH region comprises amino acids 1-120 of SEQ ID NO:349 or a variant thereof comprising 1, 2, 3, or 4 conservative amino acid substitutions; wherein the VL region comprises amino acids 1-97 of SEQ ID NO:351 or a variant thereof comprising 1, 2, 3, or 4 conservative amino acid substitutions;

lxxxviii) wherein the VH region comprises amino acids 1-121 of SEQ ID NO:353 or a variant thereof comprising 1, 2, 3, or 4 conservative amino acid substitutions; wherein the VL region comprises amino acids 1-99 of SEQ ID NO:355 or a variant thereof comprising 1, 2, 3, or 4 conservative amino acid substitutions;

lxxxix) wherein the VH region comprises amino acids 1-121 of SEQ ID NO:357 or a variant thereof comprising 1, 2, 3, or 4 conservative amino acid substitutions; wherein the VL region comprises amino acids 1-99 of SEQ ID NO:359 or a variant thereof comprising 1, 2, 3, or 4 conservative amino acid substitutions;

xc) wherein the VH region comprises amino acids 1-121 of SEQ ID NO:361 or a variant thereof comprising 1, 2, 3, or 4 conservative amino acid substitutions; wherein the VL region comprises amino acids 1-99 of SEQ ID NO:363 or a variant thereof comprising 1, 2, 3, or 4 conservative amino acid substitutions;

xci) wherein the VH region comprises amino acids 1-121 of SEQ ID NO:365 or a variant thereof comprising 1, 2, 3, or 4 conservative amino acid substitutions; wherein the VL region comprises amino acids 1-99 of SEQ ID NO:367 or a variant thereof comprising 1, 2, 3, or 4 conservative amino acid substitutions;

xcii) wherein the VH region comprises amino acids 1-120 of SEQ ID NO:369 or a variant thereof comprising 1, 2, 3, or 4 conservative amino acid substitutions; wherein the VL region comprises amino acids 1-98 of SEQ ID NO:371 or a variant thereof comprising 1, 2, 3, or 4 conservative amino acid substitutions;

xciii) wherein the VH region comprises amino acids 1-121 of SEQ ID NO:373 or a variant thereof comprising 1, 2, 3, or 4 conservative amino acid substitutions; wherein the VL region comprises amino acids 1-99 of SEQ ID NO:375 or a variant thereof comprising 1, 2, 3, or 4 conservative amino acid substitutions;

xciv) wherein the VH region comprises amino acids 1-121 of SEQ ID NO:377 or a variant thereof comprising 1, 2, 3, or 4 conservative amino acid substitutions; wherein the VL region comprises amino acids 1-99 of SEQ ID NO:379 or a variant thereof comprising 1, 2, 3, or 4 conservative amino acid substitutions;

xcv) wherein the VH region comprises amino acids 1-120 of SEQ ID NO:381 or a variant thereof comprising 1, 2, 3, or 4 conservative amino acid substitutions; wherein the VL region comprises amino acids 1-96 of SEQ ID NO:383 or a variant thereof comprising 1, 2, 3, or 4 conservative amino acid substitutions;

xcvi) wherein the VH region comprises amino acids 1-120 of SEQ ID NO:385 or a variant thereof comprising 1, 2, 3, or 4 conservative amino acid substitutions; wherein the VL region comprises amino acids 1-96 of SEQ ID NO:387 or a variant thereof comprising 1, 2, 3, or 4 conservative amino acid substitutions;

xcvii) wherein the VH region comprises amino acids 1-120 of SEQ ID NO:389 or a variant thereof comprising 1, 2, 3, or 4 conservative amino acid substitutions; wherein the VL region comprises amino acids 1-96 of SEQ ID NO:391 or a variant thereof comprising 1, 2, 3, or 4 conservative amino acid substitutions;

xcviii) wherein the VH region comprises amino acids 1-125 of SEQ ID NO:393 or a variant thereof comprising 1, 2, 3, or 4 conservative amino acid substitutions; wherein the VL region comprises amino acids 1-101 of SEQ ID NO:395 or a variant thereof comprising 1, 2, 3, or 4 conservative amino acid substitutions;

xcix) wherein the VH region comprises and amino acids 1-120 of SEQ ID NO:397 or a variant thereof comprising 1, 2, 3, or 4 conservative amino acid substitutions; and wherein the VL region comprises amino acids 1-97 of SEQ ID NO:399 or a variant thereof comprising 1, 2, 3, or 4 conservative amino acid substitutions.

In some embodiments, the anti-HIV antibody is selected from the group consisting of:

i) an antibody comprising a heavy chain variable region, wherein the CDRs comprise amino acid sequences GYDFIDYV (SEQ ID NO:401), MNPSGGGT (SEQ ID NO:402) and VRDRANGSGRRRFESVNWFLDL (SEQ ID NO:403);

ii) an antibody comprising a light chain variable region, wherein the CDRs comprise amino acid sequences HNY, DFN and WAFEN (SEQ ID NO:404);

iii) an antibody comprising a heavy chain variable region, wherein the CDRs comprise amino acid sequences GYRFPDYI (SEQ ID NO:497), MNPMGGQV (SEQ ID NO:421) and VRDRSNGSGKRFESSNWFLDL (SEQ ID NO:441);

iv) an antibody comprising a light chain variable region, wherein the CDRs comprise amino acid sequences HNL, DFN and WAYEA (SEQ ID NO:408);

v) an antibody comprising a heavy chain variable region, wherein the CDRs comprise amino acid sequences GYKFPDYI (SEQ ID NO:405), INPMGGQV (SEQ ID NO:406) and VRDRSNGSGRRFESSN (SEQ ID NO:407);

vi) an antibody comprising a heavy chain variable region, wherein the CDRs comprise amino acid sequences GYTFTDYL (SEQ ID NO:409), MNPVYGQV (SEQ ID NO:410) and VRDTGDGSRRHFDSINWFLDL (SEQ ID NO:411);

vii) an antibody comprising a light chain variable region, wherein the CDRs comprise amino acid sequences HNY, DFD and WAFEA (SEQ ID NO:412);

viii) an antibody comprising a heavy chain variable region, wherein the CDRs comprise amino acid sequences GYTFTDYV (SEQ ID NO:413), IDPPYGQV (SEQ ID NO:414) and VRDRSNGWGKRFESSNWFLDL (SEQ ID NO:415);

ix) an antibody comprising a heavy chain variable region, wherein the CDRs comprise amino acid sequences GYTFTDYV (SEQ ID NO:413), INPGYGQV (SEQ ID NO:431) and VRDRSNGWGKRFESSNWFLDL (SEQ ID NO:415);

x) an antibody comprising a heavy chain variable region, wherein the CDRs comprise amino acid sequences GYTFVDYF (SEQ ID NO:416), MDPLNGRP (SEQ ID NO:417) and VRDKSNGSGRRFDSSNWFLDL (SEQ ID NO:418);

xi) an antibody comprising a light chain variable region, wherein the CDRs comprise amino acid sequences HNY, DFN and WAYDA (SEQ ID NO:419);

xii) an antibody comprising a heavy chain variable region, wherein the CDRs comprise amino acid sequences GYTFSDYI (SEQ ID NO:420), MNPMGGQV (SEQ ID NO:421) and VRDRSNGSGKRFESSNWFLDL (SEQ ID NO:441);

xiii) an antibody comprising a light chain variable region, wherein the CDRs comprise amino acid sequences HNL, DFN and WAYEV (SEQ ID NO:422);

xiv) an antibody comprising a heavy chain variable region, wherein the CDRs comprise amino acid sequences GYTFIDYI (SEQ ID NO:423), IDPMNGRP (SEQ ID NO:424) and VRDKSNGSGKRFDSSNWFLDL (SEQ ID NO:425);

xv) an antibody comprising a heavy chain variable region, wherein the CDRs comprise amino acid sequences GYTFTDYI (SEQ ID NO:426), MNPMGGRT (SEQ ID NO:427) and VRDKSNGSGKRFDSSNWFLDL (SEQ ID NO:425);

xvi) an antibody comprising a heavy chain variable region, wherein the CDRs comprise amino acid sequences GYTFVDYL (SEQ ID NO:428), MDPMNGRP (SEQ ID NO:429) and VRDKSGGSGKLFDSSNWFLDL (SEQ ID NO:430);

xvii) an antibody comprising a heavy chain variable region, wherein the CDRs comprise amino acid sequences GYTFTDYV (SEQ ID NO:413), MDPSYGQV (SEQ ID NO:432) and VRDRSHGSGRQFESSNWFLDL (SEQ ID NO:433);

xviii) an antibody comprising a heavy chain variable region, wherein the CDRs comprise amino acid sequences GYTFTDYV (SEQ ID NO:413), MDPSFGQM (SEQ ID NO:434) and VRDRSHGSGRLFESSNWFLDL (SEQ ID NO:435);

xix) an antibody comprising a heavy chain variable region, wherein the CDRs comprise amino acid sequences GYRFTDYV (SEQ ID NO:436), MDPSFGRM (SEQ ID NO:437) and VRDRSHGSGRLFESSNWFLDL (SEQ ID NO:435);

xx) an antibody comprising a heavy chain variable region, wherein the CDRs comprise amino acid sequences GYTFIDYV (SEQ ID NO:438), MDPTYGRM (SEQ ID NO:439) and VRDRSHGSGRLFESSNWFLDL (SEQ ID NO:435);

xxi) an antibody comprising a heavy chain variable region, wherein the CDRs comprise amino acid sequences GYRFLDYI (SEQ ID NO:440), MNPMGGQV (SEQ ID NO:421) and VRDRSNGSGKRFESSNWFLDL (SEQ ID NO:441);

xxii) an antibody comprising a heavy chain variable region, wherein the CDRs comprise amino acid sequences GYKFMDQL (SEQ ID NO:442), MNPTYGQV (SEQ ID NO:443) and ARGPSGENYPFHY (SEQ ID NO:444);

xxiii) an antibody comprising a light chain variable region, wherein the CDRs comprise amino acid sequences RHII (SEQ ID NO:445), DDD and NTYEF (SEQ ID NO:446);

xxiv) an antibody comprising a heavy chain variable region, wherein the CDRs comprise amino acid sequences GYNFVDSR (SEQ ID NO:447), INPLQGGV (SEQ ID NO:448) and ARGIDGKSYPFHF (SEQ ID NO:449);

xxv) an antibody comprising a light chain variable region, wherein the CDRs comprise amino acid sequences S, ESS and SILEF (SEQ ID NO:450);

xxvi) an antibody comprising a heavy chain variable region, wherein the CDRs comprise amino acid sequences GYTFTTHHGHF (SEQ ID NO:500), MNPMTGQM (SEQ ID NO:462) and ARGDFGQNYPFHY (SEQ ID NO:463);

xxvii) an antibody comprising a light chain variable region, wherein the CDRs comprise amino acid sequences NRYL (SEQ ID NO:464), DDN and ASYER (SEQ ID NO:465);

xxviii) an antibody comprising a heavy chain variable region, wherein the CDRs comprise amino acid sequences GYNFMDQF (SEQ ID NO:466), MNPIYGQV (SEQ ID NO:467) and ARGPSGENYPFHY (SEQ ID NO:444);

xxix) an antibody comprising a light chain variable region, wherein the CDRs comprise amino acid sequences RHII (SEQ ID NO:445), DDD and NTYEF (SEQ ID NO:446);

xxx) an antibody comprising a heavy chain variable region, wherein the CDRs comprise amino acid sequences GYNFVDSR (SEQ ID NO:447), INPLHGGV (SEQ ID NO:468) and ARGIDGKSYPFHF (SEQ ID NO:449);

xxxi) an antibody comprising a heavy chain variable region, wherein the CDRs comprise amino acid sequences GYTFTKYF (SEQ ID NO:451), IHPRTGAV (SEQ ID NO:452) and ARGAFEADSYGSSYPFHH (SEQ ID NO:453);

xxxii) an antibody comprising a light chain variable region, wherein the CDRs comprise amino acid sequences GNYNP (SEQ ID NO:454), EDN and ASFEF (SEQ ID NO:455);

xxxiii) an antibody comprising a heavy chain variable region, wherein the CDRs comprise amino acid sequences GYTFTKYT (SEQ ID NO:456), IHPRTGAV (SEQ ID NO:452) and ARGAFEADLSGPTYPFHH (SEQ ID NO:457);

xxxiv) an antibody comprising a heavy chain variable region, wherein the CDRs comprise amino acid sequences GFNFIDSV (SEQ ID NO:458), IKPLRGAV (SEQ ID NO:459) and AKGAFRGGSPFGF (SEQ ID NO:460);

xxxv) an antibody comprising a light chain variable region, wherein the CDRs comprise amino acid sequences DVT and ASREF (SEQ ID NO:461);

xxxvi) an antibody comprising a heavy chain variable region, wherein the CDRs comprise amino acid sequences GYTFTSYF (SEQ ID NO:469), INPLHGAV (SEQ ID NO:470) and TRGIVADGWPYGH (SEQ ID NO:471);

xxxvii) an antibody comprising a light chain variable region, wherein the CDRs comprise amino acid sequences S, EGA and SSLQF (SEQ ID NO:472);

xxxviii) an antibody comprising a heavy chain variable region, wherein the CDRs comprise amino acid sequences GFTFIDHI (SEQ ID NO:473), IKPLRGAV (SEQ ID NO:459) and CKAAAPEEAFPLQY (SEQ ID NO:474);

xxxix) an antibody comprising a light chain variable region, wherein the CDRs comprise amino acid sequences NVD, DNN and SSRTF (SEQ ID NO:475);

xl) an antibody comprising a heavy chain variable region, wherein the CDRs comprise amino acid sequences GFKFIDHI (SEQ ID NO:476), IKPLGGVA (SEQ ID NO:477) and CKAAAPDEAFPLEY (SEQ ID NO:478);

xli) an antibody comprising a light chain variable region, wherein the CDRs comprise amino acid sequences NVD, DNN and SSTTF (SEQ ID NO:479);

xlii) an antibody comprising a heavy chain variable region, wherein the CDRs comprise amino acid sequences GFAFLDH (SEQ ID NO:480), VKTIGGVV (SEQ ID NO:481) and SKAAAPDEAFPLEF (SEQ ID NO:482);

xliii) an antibody comprising a heavy chain variable region, wherein the CDRs comprise amino acid sequences GFAFLDHI (SEQ ID NO:486), VKTIGGVV (SEQ ID NO:481) and SKAAAPDEAFPLEF (SEQ ID NO:482);

xliv) an antibody comprising a heavy chain variable region, wherein the CDRs comprise amino acid sequences GFKFTEYF (SEQ ID NO:483), LNPLRGAV (SEQ ID NO:484), ARAVFNEAFPFDY (SEQ ID NO:485);

xlv) an antibody comprising a light chain variable region, wherein the CDRs comprise amino acid sequences VS, DGD and ASREF (SEQ ID NO:461);

xlvi) an antibody comprising a light chain variable region, wherein the CDRs comprise amino acid sequences NVD, DND and SSTTF (SEQ ID NO:479);

xlvii) an antibody comprising a heavy chain variable region, wherein the CDRs comprise amino acid sequences GFNFIDSV (SEQ ID NO:458), IKPLRGGV (SEQ ID NO:490) and AKGAFGGSSPFGF (SEQ ID NO:491);

xlviii) an antibody comprising a heavy chain variable region, wherein the CDRs comprise amino acid sequences GFKFIDSV (SEQ ID NO:487), IKPLGGAV (SEQ ID NO:488) and AKGAFGGGSPFGF (SEQ ID NO:489);

xlix) an antibody comprising a heavy chain variable region, wherein the CDRs comprise amino acid sequences GFTFIKYT (SEQ ID NO:492), IHPRTGAV (SEQ ID NO:452) and ARGAFEADLYGPTYPFHH (SEQ ID NO:493);

l) an antibody comprising a light chain variable region, wherein the CDRs comprise amino acid sequences GSYNP (SEQ ID NO:494), DDN and ASFEF (SEQ ID NO:455); and li) an antibody comprising a heavy chain variable region, wherein the CDRs comprise amino acid sequences GYNFVDSL (SEQ ID NO:495), INPLQGGV (SEQ ID NO:448) and ARGIDGNSYPFHF (SEQ ID NO:496).

In some embodiments, the anti-HIV antibody is selected from the group consisting of:

a. an antibody comprising a heavy chain variable region, wherein the CDRs comprise amino acid sequences GYDFIDYV (SEQ ID NO:401), MNPSGGGT (SEQ ID NO:402) and VRDRANGSGRRRFESVNWFLDL (SEQ ID NO:403); and a light chain variable region, wherein the CDRs comprise amino acid sequences HNY, DFN and WAFEN (SEQ ID NO:404);

b. an antibody comprising a heavy chain variable region, wherein the CDRs comprise amino acid sequences GYRFPDYI (SEQ ID NO:497), MNPMGGQV (SEQ ID NO:421) and VRDRSNGSGKRFESSNWFLDL (SEQ ID NO:441); and a light chain variable region, wherein the CDRs comprise amino acid sequences HNL, DFN and WAYEA (SEQ ID NO:408);

c. an antibody comprising a heavy chain variable region, wherein the CDRs comprise amino acid sequences GYKFPDYI (SEQ ID NO:405), INPMGGQV (SEQ ID NO:406) and VRDRSNGSGRRFESSN (SEQ ID NO:407); and a light chain variable region, wherein the CDRs comprise amino acid sequences HNL, DFN and WAYEA (SEQ ID NO:408);

d. an antibody comprising a heavy chain variable region, wherein the CDRs comprise amino acid sequences GYTFTDYL (SEQ ID NO:409), MNPVYGQV (SEQ ID NO:410) and VRDTGDGSRRHFDSINWFLDL (SEQ ID NO:411); and a light chain variable region, wherein the CDRs comprise amino acid sequences HNY, DFD and WAFEA (SEQ ID NO:412);

e. an antibody comprising a heavy chain variable region, wherein the CDRs comprise amino acid sequences GYTFTDYV (SEQ ID NO:413), IDPPYGQV (SEQ ID NO:414) and VRDRSNGWGKRFESSNWFLDL (SEQ ID NO:415); and a light chain variable region, wherein the CDRs comprise amino acid sequences HNL, DFN and WAYEA (SEQ ID NO:408);

f. an antibody comprising a heavy chain variable region, wherein the CDRs comprise amino acid sequences GYTFTDYV (SEQ ID NO:413), INPGYGQV (SEQ ID NO:431) and VRDRSNGWGKRFESSNWFLDL (SEQ ID NO:415); and a light chain variable region, wherein the CDRs comprise amino acid sequences HNL, DFN and WAYEA (SEQ ID NO:408);

g. an antibody comprising a heavy chain variable region, wherein the CDRs comprise amino acid sequences GYTFVDYF (SEQ ID NO:416), MDPLNGRP (SEQ ID NO:417) and VRDKSNGSGRRFDSSNWFLDL (SEQ ID NO:418); and a light chain variable region, wherein the CDRs comprise amino acid sequences HNY, DFN and WAYDA (SEQ ID NO:419);

h. an antibody comprising a heavy chain variable region, wherein the CDRs comprise amino acid sequences GYTFSDYI (SEQ ID NO:420), MNPMGGQV (SEQ ID NO:421) and VRDRSNGSGKRFESSNWFLDL (SEQ ID NO:441); and a light chain variable region, wherein the CDRs comprise amino acid sequences HNL, DFN and WAYEV (SEQ ID NO:422);

i. an antibody comprising a heavy chain variable region, wherein the CDRs comprise amino acid sequences GYTFIDYI (SEQ ID NO:423), IDPMNGRP (SEQ ID NO:424) and VRDKSNGSGKRFDSSNWFLDL (SEQ ID NO:425); and a light chain variable region, wherein the CDRs comprise amino acid sequences HNY, DFN and WAYDA (SEQ ID NO:419);

j. an antibody comprising a heavy chain variable region, wherein the CDRs comprise amino acid sequences GYTFTDYI (SEQ ID NO:426), MNPMGGRT (SEQ ID NO:427) and VRDKSNGSGKRFDSSNWFLDL (SEQ ID NO:425); and a light chain variable region, wherein the CDRs comprise amino acid sequences HNL, DFN and WAYEA (SEQ ID NO:408);

k. an antibody comprising a heavy chain variable region, wherein the CDRs comprise amino acid sequences GYTFVDYL (SEQ ID NO:428), MDPMNGRP (SEQ ID NO:429) and VRDKSGGSGKLFDSSNWFLDL (SEQ ID NO:430); and a light chain variable region, wherein the CDRs comprise amino acid sequences HNY, DFN and WAYDA (SEQ ID NO:419);

l. an antibody comprising a heavy chain variable region, wherein the CDRs comprise amino acid sequences GYTFTDYV (SEQ ID NO:413), INPGYGQV (SEQ ID NO:431) and VRDRSNGWGKRFESSNWFLDL (SEQ ID NO:415); and a light chain variable region, wherein the CDRs comprise amino acid sequences HNL, DFN and WAYEA (SEQ ID NO:408);

m. an antibody comprising a heavy chain variable region, wherein the CDRs comprise amino acid sequences GYTFTDYV (SEQ ID NO:413), MDPSYGQV (SEQ ID NO:432) and VRDRSHGSGRQFESSNWFLDL (SEQ ID NO:433); and a light chain variable region, wherein the CDRs comprise amino acid sequences HNL, DFN and WAYEA (SEQ ID NO:408);

n. an antibody comprising a heavy chain variable region, wherein the CDRs comprise amino acid sequences GYTFTDYV (SEQ ID NO:413), MDPSFGQM (SEQ ID NO:434) and VRDRSHGSGRLFESSNWFLDL (SEQ ID NO:435); and a light chain variable region, wherein the CDRs comprise amino acid sequences HNL, DFN and WAYEA (SEQ ID NO:408);

o. an antibody comprising a heavy chain variable region, wherein the CDRs comprise amino acid sequences GYRFTDYV (SEQ ID NO:436), MDPSFGRM (SEQ ID NO:437) and VRDRSHGSGRLFESSNWFLDL (SEQ ID NO:435); and a light chain variable region, wherein the CDRs comprise amino acid sequences HNL, DFN and WAYEA (SEQ ID NO:408);

p. an antibody comprising a heavy chain variable region, wherein the CDRs comprise amino acid sequences GYTFIDYV (SEQ ID NO:438), MDPTYGRM (SEQ ID NO:439) and VRDRSHGSGRLFESSNWFLDL (SEQ ID NO:435); and a light chain variable region, wherein the CDRs comprise amino acid sequences HNL, DFN and WAYEA (SEQ ID NO:408);

q. an antibody comprising a heavy chain variable region, wherein the CDRs comprise amino acid sequences GYRFLDYI (SEQ ID NO:440), MNPMGGQV (SEQ ID NO:421) and VRDRSNGSGKRFESSNWFLDL (SEQ ID NO:441); and a light chain variable region, wherein the CDRs comprise amino acid sequences HNL, DFN and WAYEA (SEQ ID NO:408);

r. an antibody comprising a heavy chain variable region, wherein the CDRs comprise amino acid sequences GYKFMDQL (SEQ ID NO:442), MNPTYGQV (SEQ ID NO:443) and ARGPSGENYPFHY (SEQ ID NO:444); and a light chain variable region, wherein the CDRs comprise amino acid sequences RHII (SEQ ID NO:445), DDD and NTYEF (SEQ ID NO:446);

s. an antibody comprising a heavy chain variable region, wherein the CDRs comprise amino acid sequences GYNFVDSR (SEQ ID NO:447), INPLQGGV (SEQ ID NO:448) and ARGIDGKSYPFHF (SEQ ID NO:449); and a light chain variable region, wherein the CDRs comprise amino acid sequences S, ESS and SILEF (SEQ ID NO:450);

t. an antibody comprising a heavy chain variable region, wherein the CDRs comprise amino acid sequences GYTFTTHHGHF (SEQ ID NO:500), MNPMTGQM (SEQ ID NO:462) and ARGDFGQNYPFHY (SEQ ID NO:463); and a light chain variable region, wherein the CDRs comprise amino acid sequences NRYL (SEQ ID NO:464), DDN and ASYER (SEQ ID NO:465);

u. an antibody comprising a heavy chain variable region, wherein the CDRs comprise amino acid sequences GYNFMDQF (SEQ ID NO:466), MNPIYGQV (SEQ ID NO:467) and ARGPSGENYPFHY (SEQ ID NO:444); and a light chain variable region, wherein the CDRs comprise amino acid sequences RHII (SEQ ID NO:445), DDD and NTYEF (SEQ ID NO:446);

v. an antibody comprising a heavy chain variable region, wherein the CDRs comprise amino acid sequences GYNFVDSR (SEQ ID NO:447), INPLHGGV (SEQ ID NO:468) and ARGIDGKSYPFHF (SEQ ID NO:449); and a light chain variable region, wherein the CDRs comprise amino acid sequences S, ESS and SILEF (SEQ ID NO:450);

w. an antibody comprising a heavy chain variable region, wherein the CDRs comprise amino acid sequences GYTFTKYF (SEQ ID NO:451), IHPRTGAV (SEQ ID NO:452) and ARGAFEADSYGSSYPFHH (SEQ ID NO:453); and a light chain variable region, wherein the CDRs comprise amino acid sequences GNYNP (SEQ ID NO:454), EDN and ASFEF (SEQ ID NO:455);

x. an antibody comprising a heavy chain variable region, wherein the CDRs comprise amino acid sequences GYTFTKYT (SEQ ID NO:456), IHPRTGAV (SEQ ID NO:452) and ARGAFEADLSGPTYPFHH (SEQ ID NO:457); and a light chain variable region, wherein the CDRs comprise amino acid sequences GNYNP (SEQ ID NO:454), EDN and ASFEF (SEQ ID NO:455);

y. an antibody comprising a heavy chain variable region, wherein the CDRs comprise amino acid sequences GFNFIDSV (SEQ ID NO:458), IKPLRGAV (SEQ ID NO:459) and AKGAFRGGSPFGF (SEQ ID NO:460); and a light chain variable region, wherein the CDRs comprise amino acid sequences DVT and ASREF (SEQ ID NO:461);

z. an antibody comprising a heavy chain variable region, wherein the CDRs comprise amino acid sequences GYTFTSYF (SEQ ID NO:469), INPLHGAV (SEQ ID NO:470) and TRGIVADGWPYGH (SEQ ID NO:471); and a light chain variable region, wherein the CDRs comprise amino acid sequences S, EGA and SSLQF (SEQ ID NO:472);

aa. an antibody comprising a heavy chain variable region, wherein the CDRs comprise amino acid sequences GFTFIDHI (SEQ ID NO:473), IKPLRGAV (SEQ ID NO:459) and CKAAAPEEAFPLQY (SEQ ID NO:474); and a light chain variable region, wherein the CDRs comprise amino acid sequences NVD, DNN and SSRTF (SEQ ID NO:475);

bb. an antibody comprising a heavy chain variable region, wherein the CDRs comprise amino acid sequences GFKFIDHI (SEQ ID NO:476), IKPLGGVA (SEQ ID NO:477) and CKAAAPDEAFPLEY (SEQ ID NO:478); and a light chain variable region, wherein the CDRs comprise amino acid sequences NVD, DNN and SSTTF (SEQ ID NO:479);

cc. an antibody comprising a heavy chain variable region, wherein the CDRs comprise amino acid sequences GFAFLDH (SEQ ID NO:480), VKTIGGVV (SEQ ID NO:481) and SKAAAPDEAFPLEF (SEQ ID NO:482); and a light chain variable region, wherein the CDRs comprise amino acid sequences NVD, DNN and SSTTF (SEQ ID NO:479);

dd. an antibody comprising a heavy chain variable region, wherein the CDRs comprise amino acid sequences GFAFLDHI (SEQ ID NO:486), VKTIGGVV (SEQ ID NO:481) and SKAAAPDEAFPLEF (SEQ ID NO:482); and a light chain variable region, wherein the CDRs comprise amino acid sequences NVD, DNN and SSTTF (SEQ ID NO:479);

ee. an antibody comprising a heavy chain variable region, wherein the CDRs comprise amino acid sequences GFKFTEYF (SEQ ID NO:483), LNPLRGAV (SEQ ID NO:484), ARAVFNEAFPFDY (SEQ ID NO:485); and a light chain variable region, wherein the CDRs comprise amino acid sequences VS, DGD and ASREF (SEQ ID NO:461);

ff. an antibody comprising a heavy chain variable region, wherein the CDRs comprise amino acid sequences GFKFIDHI (SEQ ID NO:476), IKPLGGVA (SEQ ID NO:477) and CKAAAPDEAFPLEY (SEQ ID NO:478); and a light chain variable region, wherein the CDRs comprise amino acid sequences NVD, DND and SSTTF (SEQ ID NO:479);

gg. an antibody comprising a heavy chain variable region, wherein the CDRs comprise amino acid sequences GFAFLDHI (SEQ ID NO:486), VKTIGGVV (SEQ ID NO:481) and SKAAAPDEAFPLEF (SEQ ID NO:482); and a light chain variable region, wherein the CDRs comprise amino acid sequences NVD, DNN and SSTTF (SEQ ID NO:479);

hh. an antibody comprising a heavy chain variable region, wherein the CDRs comprise amino acid sequences GFNFIDSV (SEQ ID NO:458), IKPLRGGV (SEQ ID NO:490) and AKGAFGGSSPFGF (SEQ ID NO:491); and a light chain variable region, wherein the CDRs comprise amino acid sequences DVT and ASREF (SEQ ID NO:461);

ii. an antibody comprising a heavy chain variable region, wherein the CDRs comprise amino acid sequences GFKFIDSV (SEQ ID NO:487), IKPLGGAV (SEQ ID NO:488) and AKGAFGGGSPFGF (SEQ ID NO:489); and a light chain variable region, wherein the CDRs comprise amino acid sequences DVT and ASREF (SEQ ID NO:461);

jj. an antibody comprising a heavy chain variable region, wherein the CDRs comprise amino acid sequences GFNFIDSV (SEQ ID NO:458), IKPLRGGV (SEQ ID NO:490) and AKGAFGGSSPFGF (SEQ ID NO:491); and a light chain variable region, wherein the CDRs comprise amino acid sequences DVT and ASREF (SEQ ID NO:461);

kk. an antibody comprising a heavy chain variable region, wherein the CDRs comprise amino acid sequences GFTFIKYT (SEQ ID NO:492), IHPRTGAV (SEQ ID NO:452) and ARGAFEADLYGPTYPFHH (SEQ ID NO:493); and a light chain variable region, wherein the CDRs comprise amino acid sequences GSYNP (SEQ ID NO:494), DDN and ASFEF (SEQ ID NO:455);

ll. an antibody comprising a heavy chain variable region, wherein the CDRs comprise amino acid sequences GYNFVDSL (SEQ ID NO:495), INPLQGGV (SEQ ID NO:448) and ARGIDGNSYPFHF (SEQ ID NO:496); and a light chain variable region, wherein the CDRs comprise amino acid sequences S, ESS and SILEF (SEQ ID NO:450).

In some embodiments, the anti-HIV antibody is selected from the group consisting of:

a. an antibody comprising a heavy chain variable region, wherein CDR H1 comprises GYDFIDYV (SEQ ID NO:401), CDR H2 comprises MNPSGGGT (SEQ ID NO:402) and CDR H3 comprises VRDRANGSGRRR-FESVNWFLDL (SEQ ID NO:403); and a light chain variable region, wherein CDR L1 comprises HNY, CDR L2 comprises DFN and CDR L3 comprises WAFEN (SEQ ID NO:404);

b. an antibody comprising a heavy chain variable region, wherein CDR H1 comprises GYKFPDYI (SEQ ID NO:405), CDR H2 comprises INPMGGQV (SEQ ID NO:406) and CDR H3 comprises VRDRSNGSGRR-FESSN (SEQ ID NO:407); and a light chain variable region, wherein CDR L1 comprises HNL, CDR L2 comprises DFN and CDR L3 comprises WAYEA (SEQ ID NO:408);

c. an antibody comprising a heavy chain variable region, wherein CDR H1 comprises GYTFTDYL (SEQ ID NO:409), CDR H2 comprises MNPVYGQV (SEQ ID NO:410) and CDR H3 comprises VRDTGDGSR-RHFDSINWFLDL (SEQ ID NO:411); and a light chain variable region, wherein CDR L1 comprises HNY, CDR L2 comprises DFD and CDR L3 comprises WAFEA (SEQ ID NO:412);

d. an antibody comprising a heavy chain variable region, wherein CDR H1 comprises GYTFTDYV (SEQ ID NO:413), CDR H2 comprises IDPPYGQV (SEQ ID NO:414) and CDR H3 comprises VRDRSNGWGKR-FESSNWFLDL (SEQ ID NO:415); and a light chain variable region, wherein CDR L1 comprises HNL, CDR L2 comprises DFN and CDR L3 comprises WAYEA (SEQ ID NO:408);

e. an antibody comprising a heavy chain variable region, wherein CDR H1 comprises GYTFVDYF (SEQ ID NO:416), CDR H2 comprises MDPLNGRP (SEQ ID NO:417) and CDR H3 comprises VRDKSNGS-GRRFDSSNWFLDL (SEQ ID NO:418); and a light chain variable region, wherein CDR L1 comprises HNY, CDR L2 comprises DFN and CDR L3 comprises WAYDA (SEQ ID NO:419);

f. an antibody comprising a heavy chain variable region, wherein CDR H1 comprises GYTFSDYI (SEQ ID NO:420), CDR H2 comprises MNPMGGQV (SEQ ID NO:421) and CDR H3 comprises VRDRSNGSGKR-FESSNWFLDL (SEQ ID NO:441); and a light chain variable region, wherein CDR L1 comprises HNL, CDR L2 comprises DFN and CDR L3 comprises WAYEV (SEQ ID NO:422);

g. an antibody comprising a heavy chain variable region, wherein CDR H1 comprises GYTFIDYI (SEQ ID NO:423), CDR H2 comprises IDPMNGRP (SEQ ID NO:424) and CDR H3 comprises VRDKSNGSGKRFDSSNWFLDL (SEQ ID NO:425); and a light chain variable region, wherein CDR L1 comprises HNY, CDR L2 comprises DFN and CDR L3 comprises WAYDA (SEQ ID NO:419);

h. an antibody comprising a heavy chain variable region, wherein CDR H1 comprises GYTFTDYI (SEQ ID NO:426), CDR H2 comprises MNPMGGRT (SEQ ID NO:427) and CDR H3 comprises VRDKSNGSGKRFDSSNWFLDL (SEQ ID NO:425); and a light chain variable region, wherein CDR L1 comprises HNL, CDR L2 comprises DFN and CDR L3 comprises WAYEA (SEQ ID NO:408);

i. an antibody comprising a heavy chain variable region, wherein CDR H1 comprises GYTFVDYL (SEQ ID NO:428), CDR H2 comprises MDPMNGRP (SEQ ID NO:429) and CDR H3 comprises VRDKSGGSGKLFDSSNWFLDL (SEQ ID NO:430); and a light chain variable region, wherein CDR L1 comprises HNY, CDR L2 comprises DFN and CDR L3 comprises WAYDA (SEQ ID NO:419);

j. an antibody comprising a heavy chain variable region, wherein CDR H1 comprises GYTFTDYV (SEQ ID NO:413), CDR H2 comprises INPGYGQV (SEQ ID NO:431) and CDR H3 comprises VRDRSNGWGKR-FESSNWFLDL (SEQ ID NO:415); and a light chain variable region, wherein CDR L1 comprises HNL, CDR L2 comprises DFN and CDR L3 comprises WAYEA (SEQ ID NO:408);

k. an antibody comprising a heavy chain variable region, wherein CDR H1 comprises GYTFTDYV (SEQ ID NO:413), CDR H2 comprises MDPSYGQV (SEQ ID NO:432) and CDR H3 comprises VRDRSHGS-GRQFESSNWFLDL (SEQ ID NO:433); and a light chain variable region, wherein CDR L1 comprises HNL, CDR L2 comprises DFN and CDR L3 comprises WAYEA (SEQ ID NO:408);

l. an antibody comprising a heavy chain variable region, wherein CDR H1 comprises GYTFTDYV (SEQ ID NO:413), CDR H2 comprises MDPSFGQM (SEQ ID NO:434) and CDR H3 comprises VRDRSHGS-GRLFESSNWFLDL (SEQ ID NO:435); and a light chain variable region, wherein CDR L1 comprises HNL, CDR L2 comprises DFN and CDR L3 comprises WAYEA (SEQ ID NO:408);

m. an antibody comprising a heavy chain variable region, wherein CDR H1 comprises GYRFTDYV (SEQ ID NO:436), CDR H2 comprises MDPSFGRM (SEQ ID NO:437) and CDR H3 comprises VRDRSHGS-GRLFESSNWFLDL (SEQ ID NO:435); and a light chain variable region, wherein CDR L1 comprises HNL, CDR L2 comprises DFN and CDR L3 comprises WAYEA (SEQ ID NO:408);

n. an antibody comprising a heavy chain variable region, wherein CDR H1 comprises GYTFIDYV (SEQ ID NO:438), CDR H2 comprises MDPTYGRM (SEQ ID NO:439) and CDR H3 comprises VRDRSHGS-GRLFESSNWFLDL (SEQ ID NO:435); and a light chain variable region, wherein CDR L1 comprises HNL, CDR L2 comprises DFN and CDR L3 comprises WAYEA (SEQ ID NO:408);

o. an antibody comprising a heavy chain variable region, wherein CDR H1 comprises GYRFLDYI (SEQ ID NO:440), CDR H2 comprises MNPMGGQV (SEQ ID NO:421) and CDR H3 comprises VRDRSNGSGKR-FESSNWFLDL (SEQ ID NO:441); and a light chain variable region, wherein CDR L1 comprises HNL, CDR L2 comprises DFN and CDR L3 comprises WAYEA (SEQ ID NO:408);

p. an antibody comprising a heavy chain variable region, wherein CDR H1 comprises GYKFMDQL (SEQ ID NO:442), CDR H2 comprises MNPTYGQV (SEQ ID NO:443) and CDR H3 comprises ARGPSGENYPFHY (SEQ ID NO:444); and a light chain variable region, wherein CDR L1 comprises RHII (SEQ ID NO:445), CDR L2 comprises DDD and CDR L3 comprises NTYEF (SEQ ID NO:446);
q. an antibody comprising a heavy chain variable region, wherein CDR H1 comprises GYNFVDSR (SEQ ID NO:447), CDR H2 comprises INPLQGGV (SEQ ID NO:448) and CDR H3 comprises ARGIDGKSYPFHF (SEQ ID NO:449); and a light chain variable region, wherein CDR L1 comprises S, CDR L2 comprises ESS and CDR L3 comprises SILEF (SEQ ID NO:450);
r. an antibody comprising a heavy chain variable region, wherein CDR H1 comprises GYTFTTHHGHF (SEQ ID NO:500), CDR H2 comprises MNPMTGQM (SEQ ID NO:462) and CDR H3 comprises ARGDFGQNYPFHY (SEQ ID NO:463); and a light chain variable region, wherein CDR L1 comprises NRYL (SEQ ID NO:464), CDR L2 comprises DDN and CDR L3 comprises ASYER (SEQ ID NO:465);
s. an antibody comprising a heavy chain variable region, wherein CDR H1 comprises GYNFMDQF (SEQ ID NO:466), CDR H2 comprises MNPIYGQV (SEQ ID NO:467) and CDR H3 comprises ARGPSGENYPFHY (SEQ ID NO:444); and a light chain variable region, wherein CDR L1 comprises RHII (SEQ ID NO:445), CDR L2 comprises DDD and CDR L3 comprises NTYEF (SEQ ID NO:446);
t. an antibody comprising a heavy chain variable region, wherein CDR H1 comprises GYNFVDSR (SEQ ID NO:447), CDR H2 comprises INPLHGGV (SEQ ID NO:468) and CDR H3 comprises ARGIDGKSYPFHF (SEQ ID NO:449); and a light chain variable region, wherein CDR L1 comprises S, CDR L2 comprises ESS and CDR L3 comprises SILEF (SEQ ID NO:450);
u. an antibody comprising a heavy chain variable region, wherein CDR H1 comprises GYTFTKYF (SEQ ID NO:451), CDR H2 comprises IHPRTGAV (SEQ ID NO:452) and CDR H3 comprises ARGAFEADSYGSSYPFHH (SEQ ID NO:453); and a light chain variable region, wherein CDR L1 comprises GNYNP (SEQ ID NO:454), CDR L2 comprises EDN and CDR L3 comprises ASFEF (SEQ ID NO:455);
v. an antibody comprising a heavy chain variable region, wherein CDR H1 comprises GYTFTKYT (SEQ ID NO:456), CDR H2 comprises IHPRTGAV (SEQ ID NO:452) and CDR H3 comprises ARGAFEADLSGPTYPFHH (SEQ ID NO:457); and a light chain variable region, wherein CDR L1 comprises GNYNP (SEQ ID NO:454), CDR L2 comprises EDN and CDR L3 comprises ASFEF (SEQ ID NO:455);
w. an antibody comprising a heavy chain variable region, wherein CDR H1 comprises GFNFIDSV (SEQ ID NO:458), CDR H2 comprises IKPLRGAV (SEQ ID NO:459) and CDR H3 comprises AKGAFRGGSPFGF (SEQ ID NO:460); and a light chain variable region, wherein CDR L1 comprises DVT and CDR L2 comprises ASREF (SEQ ID NO:461);
x. an antibody comprising a heavy chain variable region, wherein CDR H1 comprises GYTFTSYF (SEQ ID NO:469), CDR H2 comprises INPLHGAV (SEQ ID NO:470) and CDR H3 comprises TRGIVADGWPYGH (SEQ ID NO:471); and a light chain variable region, wherein CDR L1 comprises S, CDR L2 comprises EGA and CDR L3 comprises SSLQF (SEQ ID NO:472);
y. an antibody comprising a heavy chain variable region, wherein CDR H1 comprises GFTFIDHI (SEQ ID NO:473), CDR H2 comprises IKPLRGAV (SEQ ID NO:459) and CDR H3 comprises CKAAAPEEAFPLQY (SEQ ID NO:474); and a light chain variable region, wherein CDR L1 comprises NVD, CDR L2 comprises DNN and CDR L3 comprises SSRTF (SEQ ID NO:475);
z. an antibody comprising a heavy chain variable region, wherein CDR H1 comprises GFKFIDHI (SEQ ID NO:476), CDR H2 comprises IKPLGGVA (SEQ ID NO:477) and CDR H3 comprises CKAAAPDEAFPLEY (SEQ ID NO:478); and a light chain variable region, wherein CDR L1 comprises NVD, CDR L2 comprises DNN and CDR L3 comprises SSTTF (SEQ ID NO:479);
aa. an antibody comprising a heavy chain variable region, wherein CDR H1 comprises GFAFLDH (SEQ ID NO:480), CDR H2 comprises VKTIGGVV (SEQ ID NO:481) and CDR H3 comprises SKAAAPDEAFPLEF (SEQ ID NO:482); and a light chain variable region, wherein CDR L1 comprises NVD, CDR L2 comprises DNN and CDR L3 comprises SSTTF (SEQ ID NO:479);
bb. an antibody comprising a heavy chain variable region, wherein CDR H1 comprises GFKFTEYF (SEQ ID NO:483), CDR H2 comprises LNPLRGAV (SEQ ID NO:484) and CDR H3 comprises ARAVFNEAFPFDY (SEQ ID NO:485); and a light chain variable region, wherein CDR L1 comprises VS, CDR L2 comprises DGD and CDR L3 comprises ASREF (SEQ ID NO:461);
cc. an antibody comprising a heavy chain variable region, wherein CDR H1 comprises GFKFIDHI (SEQ ID NO:476), CDR H2 comprises IKPLGGVA (SEQ ID NO:477) and CDR H3 comprises CKAAAPDEAFPLEY (SEQ ID NO:478); and a light chain variable region, wherein CDR L1 comprises NVD, CDR L2 comprises DND and CDR L3 comprises SSTTF (SEQ ID NO:479);
dd. an antibody comprising a heavy chain variable region, wherein CDR H1 comprises GFAFLDHI (SEQ ID NO:486), CDR H2 comprises VKTIGGVV (SEQ ID NO:481) and CDR H3 comprises SKAAAPDEAFPLEF (SEQ ID NO:482); and a light chain variable region, wherein CDR L1 comprises NVD, CDR L2 comprises DNN and CDR L3 comprises SSTTF (SEQ ID NO:479);
ee. an antibody comprising a heavy chain variable region, wherein CDR H1 comprises GFKFIDSV (SEQ ID NO:487), CDR H2 comprises IKPLGGAV (SEQ ID NO:488) and CDR H3 comprises AKGAFGGGSPFGF (SEQ ID NO:489); and a light chain variable region, wherein CDR L1 comprises DVT and CDR L2 comprises ASREF (SEQ ID NO:461);
ff. an antibody comprising a heavy chain variable region, wherein CDR H1 comprises GFNFIDSV (SEQ ID NO:458), CDR H2 comprises IKPLRGGV (SEQ ID NO:490) and CDR H3 comprises AKGAFGGSSPFGF (SEQ ID NO:491); and a light chain variable region, wherein CDR L1 comprises DVT and CDR L2 comprises ASREF (SEQ ID NO:461);
gg. an antibody comprising a heavy chain variable region, wherein CDR H1 comprises GFTFIKYT (SEQ ID NO:492), CDR H2 comprises IHPRTGAV (SEQ ID NO:452) and CDR H3 comprises ARGAFEADLYGP-TYPFHH (SEQ ID NO:493); and a light chain variable region, wherein CDR L1 comprises GSYNP (SEQ ID NO:494), CDR L2 comprises DDN and CDR L3 comprises ASFEF (SEQ ID NO:455);

hh. an antibody comprising a heavy chain variable region, wherein CDR H1 comprises GYNFVDSL (SEQ ID NO:495), CDR H2 comprises INPLQGGV (SEQ ID NO:448) and CDR H3 comprises ARGIDGNSYPFHF (SEQ ID NO:496); and a light chain variable region, wherein CDR L1 comprises S, CDR L2 comprises ESS and CDR L3 comprises SILEF (SEQ ID NO:450);

ii. an antibody comprising a heavy chain variable region, wherein CDR H1 comprises GYRFPDYI (SEQ ID NO:497), CDR H2 comprises MNPTYGQV (SEQ ID NO:443) and CDR H3 comprises VRDRSNGSGKR-FESSNWFLDL (SEQ ID NO:441); and a light chain variable region, wherein CDR L1 comprises HNL, CDR L2 comprises DFN and CDR L3 comprises WAYEA (SEQ ID NO:408);

jj. an antibody comprising a heavy chain variable region, wherein CDR H1 comprises GYRFPDYI (SEQ ID NO:497), CDR H2 comprises MNPMGGQV (SEQ ID NO:421) and CDR H3 comprises VRDRSNGSGKR-FESSNWFLDL (SEQ ID NO:441); and a light chain variable region, wherein CDR L1 comprises HNY, CDR L2 comprises DFN and CDR L3 comprises WAFEN (SEQ ID NO:404);

kk. an antibody comprising a heavy chain variable region, wherein CDR H1 comprises GYRFPDYI (SEQ ID NO:497), CDR H2 comprises MNPMGGQV (SEQ ID NO:421) and CDR H3 comprises VRDRSNGSGKR-FESSNWFLDL (SEQ ID NO:441); and a light chain variable region, wherein CDR L1 comprises HNY, CDR L2 comprises DFD and CDR L3 comprises WAFEA (SEQ ID NO:412);

ll. an antibody comprising a heavy chain variable region, wherein CDR H1 comprises GYRFPDYI (SEQ ID NO:497), CDR H2 comprises MNPMGGQV (SEQ ID NO:421) and CDR H3 comprises VRDRSNGSGKR-FESSNWFLDL (SEQ ID NO:441); and a light chain variable region, wherein CDR L1 comprises RHII (SEQ ID NO:445), CDR L2 comprises DDD and CDR L3 comprises NTYEF (SEQ ID NO:446);

mm. an antibody comprising a heavy chain variable region, wherein CDR H1 comprises GYRFPDYI (SEQ ID NO:497), CDR H2 comprises MNPMGGQV (SEQ ID NO:421) and CDR H3 comprises VRDRSNGSGKRFESSNWFLDL (SEQ ID NO:441); and a light chain variable region, wherein CDR L1 comprises HNY, CDR L2 comprises DFN and CDR L3 comprises WAYDA (SEQ ID NO:419);

nn. an antibody comprising a heavy chain variable region, wherein CDR H1 comprises GYRFPDYI (SEQ ID NO:497), CDR H2 comprises MNPMGGQV (SEQ ID NO:421) and CDR H3 comprises VRDRSNGSGKR-FESSNWFLDL (SEQ ID NO:441); and a light chain variable region, wherein CDR L1 comprises HNL, CDR L2 comprises DFN and CDR L3 comprises WAYEA (SEQ ID NO:408);

oo. an antibody comprising a heavy chain variable region, wherein CDR H1 comprises GYKFMDQL (SEQ ID NO:442), CDR H2 comprises MNPTYGQV (SEQ ID NO:443) and CDR H3 comprises VRDRSNGSGKR-FESSN (SEQ ID NO:498); and a light chain variable region, wherein CDR L1 comprises RHII (SEQ ID NO:445), CDR L2 comprises DDD and CDR L3 comprises NTYEF (SEQ ID NO:446);

pp. an antibody comprising a heavy chain variable region, wherein CDR H1 comprises GYKFMDQL (SEQ ID NO:442), CDR H2 comprises (SEQ ID NO:443) and CDR H3 comprises VRDRSNGSGKRFESSNWFLDL (SEQ ID NO:441); and a light chain variable region, wherein CDR L1 comprises RHII (SEQ ID NO:445), CDR L2 comprises DDD and CDR L3 comprises NTYEF (SEQ ID NO:446); and qq. an antibody comprising a heavy chain variable region, wherein CDR H1 comprises GYRFLDYI (SEQ ID NO:440), CDR H2 comprises MNPMGGQV (SEQ ID NO:421) and CDR H3 comprises VRDRSNGSGKR-FESSNWFLDL (SEQ ID NO:441); and a light chain variable region, wherein CDR L1 comprises HNL, CDR L2 comprises DFN and CDR L3 comprises WAYEA (SEQ ID NO:408).

In some embodiments, the anti-HIV antibody is a non-naturally occurring antibody. In some embodiments, the anti-HIV antibody is selected from the group consisting of: N49P6; N49P6.2; N49P7; N49P7.1; N49P7A; N49P7S; N49P7F; N49P7Y; N49P7-54TY; N49P7LS-1; N49P7LS-2; N49P7YTE; N49P7L6; N49P7L11; N49P7.1L9; N49P7.1L19 R49P7; N49P7.2; N49P11; N49P18; N49P18.2; N49P18.1; N49P19; N49P37; N49P38; N49P38.1; N49P55; N49P56; N49P57; N49P58; N49P59; N49P73; N49P74; N49P75; N49P75.1; N49P9; N49P9.1; N49P9.2; N49P9i7; N49P9i7H1; N49P9i7H2; N49P22; N49P23; N49P9.3; N49P9.4; N49P51; N49P52; N49P53; N49P54; N49P60; N49P61; N49P62; N49P63; N49P64; N49P65; N49P66; N49P67; N49P68; N49P69; N49P70; N49P71; and N49P72.

In some embodiments, the invention provides antibodies or antigen binding fragments comprise the CDRs as shown in the Table 2 below with up to four (i.e. 0, 1, 2, 3, or 4) conservative amino acid substitutions per CDR.

| Natural antibody | Related variants | Amino Acid sequence |
|---|---|---|
| Sequence 1 | N49P6, N49P6.2 | AGLMQSGAVMKNSGASVRVSCQADGYDFIDYVIHWFRQRRGEGLEW LGWMNPSGGGTNYPRPFQGKVTMTRDTSTETAYLDVRGLTYDDTAV YYCVRDRANGSGRRRFESVNWFLDLWGRGTQITVVSPSTKGPSVFPL APSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTC PPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCK VSNKALPAPIEKTISKAKGQPREPQVYTLPPSRDELTKNQVSLTCLVKGF YPSDIAVEWESNGQPENNYKTTPPVLDSDGSFFLYSKLTVDKSRWQQG NVFSCSVMHEALHNHYTQKSLSLSPGK<br>SEQ ID NO: 1<br>QSALTQPRSVSASPGQSVTISCTGTHNYVSWCQQKPGQAPKLLIYDFNK |

| Natural antibody | Related variants | Amino Acid sequence |
|---|---|---|
| | | RPSGVSDRFSGSTSGNTASLTISGLQADDEGHYFCWAFENIGGGTKLTV<br>LRQPKAAPSVTLFPPSSEELQANKATLVCLISDFYPGAVTVAWKADSSP<br>VKAGVETTTPSKQSNNKYAASSYLSLTPEQWKSHRSYSCQVTHEGSTV<br>EKTVAPTECS<br>SEQ ID NO: 2 |
| Sequence 2 | N49P7,<br>N49P7.1<br>N49P7A<br>N49P7S<br>N49P7F<br>N49P7Y<br>N49P7.54<br>N49P7-LS1<br>N49P7-LS2<br>N49P7/6L<br>N49P7/11L<br>R49P7 | ADLVQSGAVVKKPGDSVRISCEAQGYRFPDYIIHWIRRAPGQGPEWMG<br>WMNPMGGQVNIPWKFQGRVSMTRDTSIETAFLDLRGLKSDDTAVYY<br>CVRDRSNGSGKRFESSNWFLDLWGRGTAVTIQSSSTKGPSVFPLAPSS<br>KSTSGGTAALGCLVKDYFPEPVTVSWNSGALTSGVHTFPAVLQSSGLY<br>SLSSVVTVPSSSLGTQTYICNVNHKPSNTKVDKKVEPKSCDKTHTCPPC<br>PAPELLGGPSVFLFPPKPKDTLMISRTPEVTCVVVDVSHEDPEVKFNWY<br>TYVDGVEVHNAKTKPREEQYNSTYRVVSVLTVLHQDWLNGKEYKCKVS<br>NKALPAPIEKTISKAKGQPREPQVYTLPPSRDELTKNQVSLTCLVKGFYP<br>SDIAVEWESNGQPENNYKTTPPVLDSDGSFFLYSKLTVDKSRWQQGNV<br>FSCSVMHEALHNHYTQKSLSLSPGK<br>SEQ ID NO: 3<br>QSALTQPRSVSASPGQSVTISCTGTHNLVSWCQHQPGRAPKLLIYDFNK<br>RPSGVPDRFSGSGSGGTASLTITGLQDDDDAEYFCWAYEAFGGGTKLT<br>VLRQPKAAPSVTLFPPSSEELQANKATLVCLISDFYPGAVTVAWKADSS<br>PVKAGVETTTPSKQSNNKYAASSYLSLTPEQWKSHRSYSCQVTHEGST<br>VEKTVAPTECS<br>SEQ ID NO: 4 |
| Sequence 3 | N49P7.2 | ADLVQSGAVVKKPGDSVRISCEAQGYKFPDYIIHWIRRAPGQGLEWM<br>GWINPMGGQVNIPWQFQGRVSMTRDTSIETAFLDLRGLKSDDTALYY<br>CVRDRSNGSGRRFESSNWFLDLWGRGTAVTVHSPSKSTSGGTAALGC<br>LVKDYFPEPVTVSWNSGALTSGVHTFPAVLQSSGLYSLSSVVTVPSSSL<br>GTQTYICNVNHKPSNTKVDKKVEPKSCDKTHTCPPCPAPELLGGPSVFL<br>FPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISK<br>AKGQPREPQVYTLPPSRDELTKNQVSLTCLVKGFYPSDIAVEWESNGQP<br>ENNYKTTPPVLDSDGSFFLYSKLTVDKSRWQQGNVFSCSVMHEALHNH<br>YTQKSLSLSPGK<br>SEQ ID NO: 5<br>QSALTQPRSVSASPGQSVTISCTGTHNLVSWCQHHPGRAPKLLIYDFNK<br>RPSGVPDRFSGSGSGGTASLTISGLQDDDDAEYFCWAYEAFGGGTKLT<br>VLRQPKAAPSVTLFPPSSEELQANKATLVCLISDFYPGAVTVAWKADSS<br>PVKAGVETTTPSKQSNNKYAASSYLSLTPEQWKSHRSYSCQVTHEGST<br>VEKTVAPTECS<br>SEQ ID NO: 6 |
| Sequence 4 | N49P11 | SAELVQSGAVVKKPGTSVKVSCQAYGYTFTDYLIHWLRQAPGQGLEW<br>MGWMNPVYGQVNYAQNFQGRVSMTRDIYRETAFLEVRDLKTDDTGT<br>YYCVRDTGDGSRRHFDSINWFLDLWGRGTWIRVAPASTKGPSVFPLA<br>PSSKSTSGGTAALGCLVKDYFPEPVTVSWNSGALTSGVHTFPAVLQSSG<br>LYSLSSVVTVPSSSLGTQTYICNVNHKPSNTKVDKKVEPKSCDKTHTCP<br>PCPAPELLGGPSVFLFPPKPKDTLMISRTPEVTCVVVDVSHEDPEVKFN<br>WYVDGVEVHNAKTKPREEQYNSTYRVVSVLTVLHQDWLNGKEYKCK<br>VSNKALPAPIEKTISKAKGQPREPQVYTLPPSRDELTKNQVSLTCLVKGF<br>YPSDIAVEWESNGQPENNYKTTPPVLDSDGSFFLYSKLTVDKSRWQQG<br>NVFSCSVMHEALHNHYTQKSLSLSPGK<br>SEQ ID NO: 7<br>QCVLTQPRSVSGSPGQSVTISCTGTHNYVSWCQHHPGNAPKLLLYDFD<br>KRPSGISDRFSGSRSGNTASLTISGLQPEDEADYFCWAFEAFGGGTKVL<br>VLRQPKAAPSVTLFPPSSEELQANKATLVCLISDFYPGAVTVAWKADSS<br>PVKAGVETTTPSKQSNNKYAASSYLSLTPEQWKSHRSYSCQVTHEGST<br>VEKTVAPTECS<br>SEQ ID NO: 8 |
| Sequence 5 | N49P18<br>N49P18.2 | ADLVQSGAVMKKPGDSVRISCEARGYTFTDYVIHWIRRAPGQGLEWM<br>GWIDPPYGQVNIPWNFQGRVSMTRDTSIETAFLDLRGLKSDDTGLYYC<br>VRDRSNGWGKRFESSNWFLDLWGRGTVVTVHSPSTKGPSVFPLAPSS<br>KSTSGGTAALGCLVKDYFPEPVTVSWNSGALTSGVHTFPAVLQSSGLY<br>SLSSVVTVPSSSLGTQTYICNVNHKPSNTKVDKKVEPKSCDKTHTCPPC<br>PAPELLGGPSVFLFPPKPKDTLMISRTPEVTCVVVDVSHEDPEVKFNWY<br>VDGVEVHNAKTKPREEQYNSTYRVVSVLTVLHQDWLNGKEYKCKVS<br>NKALPAPIEKTISKAKGQPREPQVYTLPPSRDELTKNQVSLTCLVKGFYP<br>SDIAVEWESNGQPENNYKTTPPVLDSDGSFFLYSKLTVDKSRWQQGNV<br>FSCSVMHEALHNHYTQKSLSLSPGK<br>SEQ ID NO: 9<br>QSALTQPRSVSASPGQSVTISCTGTHNLVSWCQHHPGRAPKLLIYDFNK<br>RPSGVPDRFSGSGSGGTASLTISGLQDDDDAEYFCWAYEAFGGGTKLT<br>VLRQPKAAPSVTLFPPSSEELQANKATLVCLISDFYPGAVTVAWKADSS |

| Natural antibody | Related variants | Amino Acid sequence |
|---|---|---|
| | | PVKAGVETTTPSKQSNNKYAASSYLSLTPEQWKSHRSYSCQVTHEGST<br>VEKTVAPTECS<br>SEQ ID NO: 10 |
| Sequence 6 | N49P18.1 | ADLVQSGAVVKKPGDSVRISCEAQGYTFTDYVIHWIRRAPGQGLEWM<br>GWINPGYGQVNIPWNFQGRVSMTRDTSIETAFLDLRGLKSDDTGLYYC<br>VRDRSNGWGKRFESSNWFLDLWGRGTVVTHSPSTKGPSVFPLAPSS<br>KSTSGGTAALGCLVKDYFPEPVTVSWNSGALTSGVHTFPAVLQSSGLY<br>SLSSVVTVPSSSLGTQTYICNVNHKPSNTKVDKKVEPKSCDKTHTCPPC<br>PAPELLGGPSVFLFPPKPKDTLMISRTPEVTCVVVDVSHEDPEVKFNWY<br>VDGVEVHNAKTKPREEQYNSTYRVVSVLTVLHQDWLNGKEYKCKVS<br>NKALPAPIEKTISKAKGQPREPQVYTLPPSRDELTKNQVSLTCLVKGFYP<br>SDIAVEWESNGQPENNYKTTPPVLDSDGSFFLYSKLTVDKSRWQQGNV<br>FSCSVMHEALHNHYTQKSLSLSPGK<br>SEQ ID NO: 11<br>QSALTQPRSMSASPGQSVTISCTGTHNLVSWCQHHPGRPPKLLIYDFNK<br>RPSGVPDRFSGSGSGGTASLTISGLQDDDDAEYICWAYEAFGGGTKLTV<br>LRQPKAAPSVTLFPPSSEELQANKATLVCLISDFYPGAVTVAWKADSSP<br>VKAGVETTTPSKQSNNKYAASSYLSLTPEQWKSHRSYSCQVTHEGSTV<br>EKTVAPTECS<br>SEQ ID NO: 12 |
| Sequence 7 | N49P19 | ADLVQSGAVVKNAGASVRVSCEAYGYTFVDYFIHWVRQAPGQGFEW<br>MGYMDPLNGRPNIARKFQGRLSLSRDRSSETSFLDLSGLRSDDSAVYY<br>CVRDKSNGSGRRFDSSNWFLDLWGRGTRVSIFSASTKGPSVFPLAPSS<br>KSTSGGTAALGCLVKDYFPEPVTVSWNSGALTSGVHTFPAVLQSSGLY<br>SLSSVVTVPSSSLGTQTYICNVNHKPSNTKVDKKVEPKSCDKTHTCPPC<br>PAPELLGGPSVFLFPPKPKDTLMISRTPEVTCVVVDVSHEDPEVKFNWY<br>VDGVEVHNAKTKPREEQYNSTYRVVSVLTVLHQDWLNGKEYKCKVS<br>NKALPAPIEKTISKAKGQPREPQVYTLPPSRDELTKNQVSLTCLVKGFYP<br>SDIAVEWESNGQPENNYKTTPPVLDSDGSFFLYSKLTVDKSRWQQGNV<br>FSCSVMHEALHNHYTQKSLSLSPGK<br>SEQ ID NO: 13<br>QSALTQPRSVSATPGQSVTISCTGTHNYVSWCQHPGRAPKLLIYDFNK<br>RPSGVPDRFSGSGSGGTASLTITGLQDDDEADYFCWAYDAFGGGTKLT<br>VLRQPKAAPSVTLFPPSSEELQANKATLVCLISDFYPGAVTVAWKADSS<br>PVKAGVETTTPSKQSNNKYAASSYLSLTPEQWKSHRSYSCQVTHEGST<br>VEKTVAPTECS<br>SEQ ID NO: 14 |
| Sequence 8 | N49P37 | ADLVQSGAVVKKPGDSVRVSCEAYGYTFSDYIIHWIRRAPGRGLEWM<br>GWMNPMGGQVNIPWNFQGRVSMTRDTSIETAFLDLRGLRSDDTAVY<br>YCVRDRSNGSGKRFESSNWFLDLWGRGTAVTISSPSTKGPSVFPLAPS<br>SKSTSGGTAALGCLVKDYFPEPVTVSWNSGALTSGVHTFPAVLQSSGL<br>YSLSSVVTVPSSSLGTQTYICNVNHKPSNTKVDKKVEPKSCDKTHTCPP<br>CPAPELLGGPSVFLFPPKPKDTLMISRTPEVTCVVVDVSHEDPEVKFNW<br>YVDGVEVHNAKTKPREEQYNSTYRVVSVLTVLHQDWLNGKEYKCKV<br>SNKALPAPIEKTISKAKGQPREPQVYTLPPSRDELTKNQVSLTCLVKGFY<br>PSDIAVEWESNGQPENNYKTTPPVLDSDGSFFLYSKLTVDKSRWQQGN<br>VFSCSVMHEALHNHYTQKSLSLSPGK<br>SEQ ID NO: 15<br>QSALTQPRSVSAAPGQSVTISCTGTHNLVSWCQHHPGRAPKLLIYDFNK<br>RPSGVPDRFSGSGSGGTASLTITGLQDDDEAEYFCWAYEVFGGGTKLT<br>VLRQPKAAPSVTLFPPSSEELQANKATLVCLISDFYPGAVTVAWKADSS<br>PVKAGVETTTPSKQSNNKYAASSYLSLTPEQWKSHRSYSCQVTHEGST<br>VEKTVAPTECS<br>SEQ ID NO: 16 |
| Sequence 9 | N49P38<br>N49P38.1 | ADLVQSGAVVKTPGASVRVSCEAYGYTFIDYIIHWVRQAPGQGFEWL<br>GYIDPMNGRPNIARKFQGRLSLSRDTSIETSFLDLSGLRSDDSAVYYC<br>RDKSNGSGKRFDSSNWFLDLWGRGTRVSISSASTKGPSVFPLAPSSKS<br>TSGGTAALGCLVKDYFPEPVTVSWNSGALTSGVHTFPAVLQSSGLYSLS<br>SVVTVPSSSLGTQTYICNVNHKPSNTKVDKKVEPKSCDKTHTCPPCPAP<br>ELLGGPSVFLFPPKPKDTLMISRTPEVTCVVVDVSHEDPEVKFNWYVDG<br>VEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIA<br>VEWESNGQPENNYKTTPPVLDSDGSFFLYSKLTVDKSRWQQGNVFSCS<br>VMHEALHNHYTQKSLSLSPGK<br>SEQ ID NO: 17<br>QSALTQPRSVSAAPGQSVTISCTGTHNYVSWCQQHPGRAPKLLIYDFNK<br>RPSGVPDRFSGSGSGGTASLTITRLQDDDDADYFCWAYDAFGGGTKLT<br>VLRQPKAAPSVTLFPPSSEELQANKATLVCLISDFYPGAVTVAWKADSS<br>PVKAGVETTTPSKQSNNKYAASSYLSLTPEQWKSHRSYSCQVTHEGST<br>VEKTVAPTECS<br>SEQ ID NO: 18 |

| Natural antibody | Related variants | Amino Acid sequence |
|---|---|---|
| Sequence 10 | N49P55 | ADLVQSGAVVKKPGASVRVSCEAYGYTFTDYIIHWIRQAPGQGLEWM<br>GWMNPMGGRTNIPWKFQGRVSMTRDTSIETAFLDLSGLTSDDTAVYY<br>CVRDKSNGSGKRFDSSNWFLDLWGRGTPVTISSPSTKGPSVFPLAPSS<br>KSTSGGTAALGCLVKDYFPEPVTVSWNSGALTSGVHTFPAVLQSSGLY<br>SLSSVVTVPSSSLGTQTYICNVNHKPSNTKVDKKVEPKSCDKTHTCPPC<br>PAPELLGGPSVFLFPPKPKDTLMISRTPEVTCVVVDVSHEDPEVKFNWY<br>VDGVEVHNAKTKPREEQYNSTYRVVSVLTVLHQDWLNGKEYKCKVS<br>NKALPAPIEKTISKAKGQPREPQVYTLPPSRDELTKNQVSLTCLVKGFYP<br>SDIAVEWESNGQPENNYKTTPPVLDSDGSFFLYSKLTVDKSRWQQGNV<br>FSCSVMHEALHNHYTQKSLSLSPGK<br>SEQ ID NO: 19<br>QSALTQPRSVSAAPGQSVTISCTGTHNLVSWCQQHPGRAPKLLIYDFNK<br>RPSGVPDRFSGSGSGGTASLSITGLQDDDEAEYFCWAYEAFGGGTKLT<br>VLRQPKAAPSVTLFPPSSEELQANKATLVCLISDFYPGAVTVAWKADSS<br>PVKAGVETTTPSKQSNNKYAASSYLSLTPEQWKSHRSYSCQVTHEGST<br>VEKTVAPTECS<br>SEQ ID NO: 20 |
| Sequence 11 | N49P56 | ADLVQSGAVVKKPGASVRVSCEAYGYTFVDYLIHWVRQAPGQGFEW<br>MGYMDPMNGRPNIARKFQGRLSLSRDTSIETSFLDLSGLRSDDSAVYY<br>CVRDKSGGSGKLFDSSNWFLDLWGRGTRVSISSASTKGPSVFPLAPSS<br>KSTSGGTAALGCLVKDYFPEPVTVSWNSGALTSGVHTFPAVLQSSGLY<br>SLSSVVTVPSSSLGTQTYICNVNHKPSNTKVDKKVEPKSCDKTHTCPPC<br>PAPELLGGPSVFLFPPKPKDTLMISRTPEVTCVVVDVSHEDPEVKFNWY<br>VDGVEVHNAKTKPREEQYNSTYRVVSVLTVLHQDWLNGKEYKCKVS<br>NKALPAPIEKTISKAKGQPREPQVYTLPPSRDELTKNQVSLTCLVKGFYP<br>SDIAVEWESNGQPENNYKTTPPVLDSDGSFFLYSKLTVDKSRWQQGNV<br>FSCSVMHEALHNHYTQKSLSLSPGK<br>SEQ ID NO: 21<br>QSALTQPRSVSAAPGQSVTISCTGTHNYVSWCQQHPGRAPKLLIYDFNK<br>RPSGVPDRFSGSGSGGTASLTITGLQDDDDADYFCWAYDAFGGGTKLT<br>VLRQPKAAPSVTLFPPSSEELQANKATLVCLISDFYPGAVTVAWKADSS<br>PVKAGVETTTPSKQSNNKYAASSYLSLTPEQWKSHRSYSCQVTHEGST<br>VEKTVAPTECS<br>SEQ ID NO: 22 |
| Sequence 12 | N49P57 | ADLVQSGAVVKKPGDSVRISCEAQGYTFTDYVIHWIRRAPGQGLEWM<br>GWINPGYGQVNIPWNFQGRVSMTRDTSIETAFLELRGLKSDDTGLYYC<br>VRDRSNGWGKRFESSNWFLDLWGRGTVITVHSPSTKGPSVFPLAPSS<br>KSTSGGTAALGCLVKDYFPEPVTVSWNSGALTSGVHTFPAVLQSSGLY<br>SLSSVVTVPSSSLGTQTYICNVNHKPSNTKVDKKVEPKSCDKTHTCPPC<br>PAPELLGGPSVFLFPPKPKDTLMISRTPEVTCVVVDVSHEDPEVKFNWY<br>VDGVEVHNAKTKPREEQYNSTYRVVSVLTVLHQDWLNGKEYKCKVS<br>NKALPAPIEKTISKAKGQPREPQVYTLPPSRDELTKNQVSLTCLVKGFYP<br>SDIAVEWESNGQPENNYKTTPPVLDSDGSFFLYSKLTVDKSRWQQGNV<br>FSCSVMHEALHNHYTQKSLSLSPGK<br>SEQ ID NO: 23<br>QSALTQPRSMSASPGQSVTISCTGTHNLVSWCQHHPGRPPKLLIYDFNK<br>RPSGVPDRFSGSGSGGTASLTITGLQDDDDAEYICWAYEAFGGGTKLTI<br>LRQPKAAPSVTLFPPSSEELQANKATLVCLISDFYPGAVTVAWKADSSP<br>VKAGVETTTPSKQSNNKYAASSYLSLTPEQWKSHRSYSCQVTHEGSTV<br>EKTVAPTECS<br>SEQ ID NO: 24 |
| Sequence 13 | N49P58 | ADLVQSGAVVKKPGDSVRISCEAQGYTFTDYVIHWIRRAPGQGLEWM<br>GWMDPSYGQVNIPRNFQGRVSMTRDTFRETAYLELRGLQSDDKGLYY<br>CVRDRSHGSGRQFESSNWFLDLWGRGTVVNVQSPSTKGPSVFPLAPS<br>SKSTSGGTAALGCLVKDYFPEPVTVSWNSGALTSGVHTFPAVLQSSGL<br>YSLSSVVTVPSSSLGTQTYICNVNHKPSNTKVDKKVEPKSCDKTHTCPP<br>CPAPELLGGPSVFLFPPKPKDTLMISRTPEVTCVVVDVSHEDPEVKFNW<br>YVDGVEVHNAKTKPREEQYNSTYRVVSVLTVLHQDWLNGKEYKCKV<br>SNKALPAPIEKTISKAKGQPREPQVYTLPPSRDELTKNQVSLTCLVKGFY<br>PSDIAVEWESNGQPENNYKTTPPVLDSDGSFFLYSKLTVDKSRWQQGN<br>VFSCSVMHEALHNHYTQKSLSLSPGK<br>SEQ ID NO: 25<br>QSALTQPRSVSASPGQSVTISCTGTHNLVSWCQHHPGRPPKLLIYDFNK<br>RASGVPDRFSGSGSGGTASLTISGLQDDDDAEYFCWAYEAFGGGTKLT<br>VLRQPKAAPSVTLFPPSSEELQANKATLVCLISDFYPGAVTVAWKADSS<br>PVKAGVETTTPSKQSNNKYAASSYLSLTPEQWKSHRSYSCQVTHEGST<br>VEKTVAPTECS<br>SEQ ID NO: 26 |
| Sequence 14 | N49P59 | ADLVQSGAVVKKPGDSLRISCEAQGYTFTDYVIHWIRRAPGQGLEWM<br>GWMDPSFGQMNIPRNFQGRVSMTRDMYIETAFLDLRGLKSDDTGLYY<br>CVRDRSHGSGRLFESSNWFLDLWGRGTVVQSPSTKGPSVFPLAPSS<br>KSTSGGTAALGCLVKDYFPEPVTVSWNSGALTSGVHTFPAVLQSSGLY |

| Natural antibody | Related variants | Amino Acid sequence |
|---|---|---|
| | | SLSSVVTVPSSSLGTQTYICNVNHKPSNTKVDKKVEPKSCDKTHTCPPC<br>PAPELLGGPSVFLFPPKPKDTLMISRTPEVTCVVVDVSHEDPEVKFNWY<br>VDGVEVHNAKTKPREEQYNSTYRVVSVLTVLHQDWLNGKEYKCKVS<br>NKALPAPIEKTISKAKGQPREPQVYTLPPSRDELTKNQVSLTCLVKGFYP<br>SDIAVEWESNGQPENNYKTTPPVLDSDGSFFLYSKLTVDKSRWQQGNV<br>FSCSVMHEALHNHYTQKSLSLSPGK<br>SEQ ID NO: 27<br>QSALTQPRSVSASPGQSVTISCTGTHNLVSWCQHHPGRPPKLLIYDFNK<br>RASGVPDRFSGSGSGGTASLTISGLQDDDDAEYFCWAYEAFGGGTKLT<br>VLRQPKAAPSVTLFPPSSEELQANKATLVCLISDFYPGAVTVAWKADSS<br>PVKAGVETTTPSKQSNNKYAASSYLSLTPEQWKSHRSYSCQVTHEGST<br>VEKTVAPTECS<br>SEQ ID NO: 28 |
| Sequence 15 | N49P73 | ADLVQSGAVVKKPGDSVRISCEAQGYRFTDYVIHWIRRAPGQGLEWM<br>GLMDPSFGRMNIPRKFQGRVSMTRDTSMETAFLDFRGLNFDDTGLYY<br>CVRDRSHGSGRLFESSNWFLDLWGRGTVVTVQSPSTKGPSVFPLAPSS<br>KSTSGGTAALGCLVKDYFPEPVTVSWNSGALTSGVHTFPAVLQSSGLY<br>SLSSVVTVPSSSLGTQTYICNVNHKPSNTKVDKKVEPKSCDKTHTCPPC<br>PAPELLGGPSVFLFPPKPKDTLMISRTPEVTCVVVDVSHEDPEVKFNWY<br>VDGVEVHNAKTKPREEQYNSTYRVVSVLTVLHQDWLNGKEYKCKVS<br>NKALPAPIEKTISKAKGQPREPQVYTLPPSRDELTKNQVSLTCLVKGFYP<br>SDIAVEWESNGQPENNYKTTPPVLDSDGSFFLYSKLTVDKSRWQQGNV<br>FSCSVMHEALHNHYTQKSLSLSPGK<br>SEQ ID NO: 29<br>QSALTQPRSVSASPGQSVTISCTGTHNLVSWCQHHPGRPPKLLIYDFNK<br>RASGVPDRFSGSGSGGTASLTISGLQDDDDAEYFCWAYEAFGGGTKLT<br>VLRQPKAAPSVTLFPPSSEELQANKATLVCLISDFYPGAVTVAWKADSS<br>PVKAGVETTTPSKQSNNKYAASSYLSLTPEQWKSHRSYSCQVTHEGST<br>VEKTVAPTECS<br>SEQ ID NO: 30 |
| Sequence 16 | N49P74 | ADLVQSGAVVKKPGDSVRISCEAQGYTFIDYVIHWIRRAPGQGLEWM<br>GLMDPTYGRMNIPRKFQGRVSMTRDTSIETAFLDLRGLKSDDTGLYYC<br>VRDRSHGSGRLFESSNWFLDLWGRGTVVTVQSPSTKGPSVFPLAPSSK<br>STSGGTAALGCLVKDYFPEPVTVSWNSGALTSGVHTFPAVLQSSGLYSL<br>SSVVTVPSSSLGTQTYICNVNHKPSNTKVDKKVEPKSCDKTHTCPPCPA<br>PELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNK<br>ALPAPIEKTISKAKGQPREPQVYTLPPSRDELTKNQVSLTCLVKGFYPSD<br>IAVEWESNGQPENNYKTTPPVLDSDGSFFLYSKLTVDKSRWQQGNVFS<br>CSVMHEALHNHYTQKSLSLSPGK<br>SEQ ID NO: 31<br>QSALTQPRSVSASPGQSVTISCTGTHNLVSWCQHHPGRPPKLLIYDFNK<br>RASGVPDRFSGSGSGGTASLTISGLQDDDDAEYFCWAYEAFGGGTKLT<br>VLRQPKAAPSVTLFPPSSEELQANKATLVCLISDFYPGAVTVAWKADSS<br>PVKAGVETTTPSKQSNNKYAASSYLSLTPEQWKSHRSYSCQVTHEGST<br>VEKTVAPTECS<br>SEQ ID NO: 32 |
| Sequence 17 | N49P75 | ADLVQSGAVVKKPGDSVRISCEAQGYRFLDYIIHWIRRAPGQGLEWM<br>GWMNPMGGQVNIPWNFQGRVSMTRDTSIETAFLDLRGLKSDDTGLY<br>YCVRDRSNGSGKRFESSNWFLDLWGRGTAVTIHSPSTKGPSVFPLAPS<br>SKSTSGGTAALGCLVKDYFPEPVTVSWNSGALTSGVHTFPAVLQSSGL<br>YSLSSVVTVPSSSLGTQTYICNVNHKPSNTKVDKKVEPKSCDKTHTCPP<br>CPAPELLGGPSVFLFPPKPKDTLMISRTPEVTCVVVDVSHEDPEVKFNW<br>YVDGVEVHNAKTKPREEQYNSTYRVVSVLTVLHQDWLNGKEYKCKV<br>SNKALPAPIEKTISKAKGQPREPQVYTLPPSRDELTKNQVSLTCLVKGFY<br>PSDIAVEWESNGQPENNYKTTPPVLDSDGSFFLYSKLTVDKSRWQQGN<br>VFSCSVMHEALHNHYTQKSLSLSPGK<br>SEQ ID NO: 33<br>QSALTQPRSVSASPGQSVTISCTGTHNLVSWCQHHPGRAPKLLIYDFNK<br>RPSGVPDRFSGSGSGGTASLTITGLQDDDDAEYFCWAYEAFGGGTKLT<br>VLRQPKAAPSVTLFPPSSEELQANKATLVCLISDFYPGAVTVAWKADSS<br>PVKAGVETTTPSKQSNNKYAASSYLSLTPEQWKSHRSYSCQVTHEGST<br>VEKTVAPTECS<br>SEQ ID NO: 34 |
| Sequence 18 | N49P9<br>N49P9.1<br>N49P9.2<br>N49P9i7 | HVQLVQSGGGVKKIGAAVRISCEVTGYKFMDQLINWVRQAPGQGLE<br>WMGWMNPTYGQVNYSWRFEGRVTMTRDMDTETAFMELRGLRVDDT<br>AVYYCARGPSGENYPFHYWGQGVRVVVSSPSTKGPSVFPLAPSSKSTS<br>GGTAALGCLVKDYFPEPVTVSWNSGALTSGVHTFPAVLQSSGLYSLSS<br>VVTVPSSSLGTQTYICNVNHKPSNTKVDKKVEPKSCDKTHTCPPCPAPE<br>LLGGPSVFLFPPKPKDTLMISRTPEVTCVVVDVSHEDPEVKFNWYVDG<br>VEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIA |

| Natural antibody | Related variants | Amino Acid sequence |
|---|---|---|
| | | VEWESNGQPENNYKTTPPVLDSDGSFFLYSKLTVDKSRWQQGNVFSCS<br>VMHEALHNHYTQKSLSLSPGK<br>SEQ ID NO: 35<br>ASALTQPASMSASPGQSVTISCSGTRHIISAWFQQYPGKPPKLIIFDDDK<br>RPSGVPSRFSASRPGDTASLTISNVQPEDEATYICNTYEFFGGGTRLTVL<br>SQPKAAPSVTLFPPSSEELQANKATLVCLVSDFYPGAVTVAWKADGSP<br>VKVGVETTKPSKQSNNKYAASSYLSLTPEQWKSHRSYSCRVTHEGSTV<br>EKTVAPAECS<br>SEQ ID NO: 36 |
| Sequence 19 | N49P22 | HIQLLQSGPQVKKSGDTVRISCETSGYNFVDSRIHWVRQTPEKRLRWM<br>GWINPLQGGVNYAPEFQGRIRMTRDTFIDTVYVDLSGLTPADTAYYYC<br>ARGIDGKSYPFHFWGHGTRVTVFSASTKGPSVFPLAPSSKSTSGGTAA<br>LGCLVKDYFPEPVTVSWNSGALTSGVHTFPAVLQSSGLYSLSSVVTVPS<br>SSLGTQTYICNVNHKPSNTKVDKKVEPKSCDKTHTCPPCPAPELLGGPS<br>VFLFPPKPKDTLMISRTPEVTCVVVDVSHEDPEVKFNWYVDGVEVHNA<br>KTKPREEQYNSTYRVVSVLTVLHQDWLNGKEYKCKVSNKALPAPIEKT<br>ISKAKGQPREPQVYTLPPSRDELTKNQVSLTCLVKGFYPSDIAVEWESN<br>GQPENNYKTTPPVLDSDGSFFLYSKLTVDKSRWQQGNVFSCSVMHEAL<br>HNHYTQKSLSLSPGK<br>SEQ ID NO: 37<br>RFALTQPASVSGSPGQTITITCAGGSVSWFHFPPGKTPRLIIYESSKRPSG<br>VSPRFSGSQSGSTASLIISGLQSDDEGTYFCSILEFFGRGTLVTVLSQPKA<br>APSVTLFPPSSEELQANKATLVCLVSDFYPGAVTVAWKADGSPVKVGV<br>ETTKPSKQSNNKYAASSYLSLTPEQWKSHRSYSCRVTHEGSTVEKTVAP<br>AECS<br>SEQ ID NO: 38 |
| Sequence 20 | N49P23 | QVRLVQSGAGARKTGASMKLSCSTSGYTFTTHHGHFINWVRQARGQ<br>GLEWMGWMNPMTGQMNIEGKFQGRVTLTRDIYSDTAYMEMTRLTT<br>GDTGTYYCARGDFGQNYPFHYWGQGSLVIVSSASTKGPSVFPLAPSSK<br>STSGGTAALGCLVKDYFPEPVTVSWNSGALTSGVHTFPAVLQSSGLYSL<br>SSVVTVPSSSLGTQTYICNVNHKPSNTKVDKKVEPKSCDKTHTCPPCPA<br>PELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNK<br>ALPAPIEKTISKAKGQPREPQVYTLPPSRDELTKNQVSLTCLVKGFYPSD<br>IAVEWESNGQPENNYKTTPPVLDSDGSFFLYSKLTVDKSRWQQGNVFS<br>CSVMHEALHNHYTQKSLSLSPGK<br>SEQ ID NO: 39<br>LSALTQPASVSGSPGQSVTISCSGTNRYLVSWYQQHPDKAPKLIIYDDN<br>KRPSGISDRFSASRPDDTASLTISGLQTGDEATYWCASYERFGGGTRLT<br>VLSQPKAAPSVTLFPPSSEELQANKATLVCLVSDFYPGAVTVAWKADG<br>SPVKVGVETTKPSKQSNNKYAASSYLSLTPEQWKSHRSYSCRVTHEGS<br>TVEKTVAPAECS<br>SEQ ID NO: 40 |
| Sequence 21 | N49P9.3<br>N49P9.4 | HVQLVQSGGGVKKIGAAVRISCEVSGYNFMDQFINWVRQAPGQGLEW<br>MGWMNPIYGQVNYSWRFQGRVTMTRDMYTDTAFMELRGLRVDDTA<br>VYYCARGPSGENYPFHYWGQGVRVVVSSPSTKGPSVFPLAPSSKSTSG<br>GTAALGCLVKDYFPEPVTVSWNSGALTSGVHTFPAVLQSSGLYSLSSV<br>VTVPSSSLGTQTYICNVNHKPSNTKVDKKVEPKSCDKTHTCPPCPAPEL<br>LGGPSVFLFPPKPKDTLMISRTPEVTCVVVDVSHEDPEVKFNWYVDGV<br>EVHNAKTKPREEQYNSTYRVVSVLTVLHQDWLNGKEYKCKVSNKALP<br>APIEKTISKAKGQPREPQVYTLPPSRDELTKNQVSLTCLVKGFYPSDIAV<br>EWESNGQPENNYKTTPPVLDSDGSFFLYSKLTVDKSRWQQGNVFSCSV<br>MHEALHNHYTQKSLSLSPGK<br>SEQ ID NO: 41<br>ASALTQPASMSASPGQSVTISCSGTRHIISAWFQQYPGKPPKLIIFDDDK<br>RPSGVPSRFSASRPGDTASLTISNVQPEDEATYICNTYEFFGGGTKLTVL<br>SQPKAAPSVTLFPPSSEELQANKATLVCLVSDFYPGAVTVAWKADGSP<br>VKVGVETTKPSKQSNNKYAASSYLSLTPEQWKSHRSYSCRVTHEGSTV<br>EKTVAPAECS<br>SEQ ID NO: 42 |
| Sequence 22 | N49P51 | HIQLLQSGPQVKKSGDTVRISCETSGYNFVDSRIHWVRQTPEKRLRWM<br>GWINPLHGGVNYAPEFQGRIRMTRDTFIDTVYVDLSGLTPADTAYYYC<br>ARGIDGKSYPFHFWGHGTRVTVFSASTKGPSVFPLAPSSKSTSGGTAA<br>LGCLVKDYFPEPVTVSWNSGALTSGVHTFPAVLQSSGLYSLSSVVTVPS<br>SSLGTQTYICNVNHKPSNTKVDKKVEPKSCDKTHTCPPCPAPELLGGPS<br>VFLFPPKPKDTLMISRTPEVTCVVVDVSHEDPEVKFNWYVDGVEVHNA<br>KTKPREEQYNSTYRVVSVLTVLHQDWLNGKEYKCKVSNKALPAPIEKT<br>ISKAKGQPREPQVYTLPPSRDELTKNQVSLTCLVKGFYPSDIAVEWESN<br>GQPENNYKTTPPVLDSDGSFFLYSKLTVDKSRWQQGNVFSCSVMHEAL<br>HNHYTQKSLSLSPGK<br>SEQ ID NO: 43<br>RFALTQPASVSGSPGQTITITCAGGSVSWFHFPPGKTPRLIIYESSKRPSG |

-continued

| Natural antibody | Related variants | Amino Acid sequence |
|---|---|---|
| | | VSPRFSGSQSGSTASLIISGLQSDDEGTYFCSILEFFGRGTLVTVLSQPKA<br>APSVTLFPPSSEELQANKATLVCLVSDFYPGAVTVAWKADGSPVKVGV<br>ETTKPSKQSNNKYAASSYLSLTPEQWKSHRSYSCRVTHEGSTVEKTVAP<br>AECS<br>SEQ ID NO: 44 |
| Sequence 23 | N49P52 | RVTLQQSGAIVRQPGASVTVSCETSGYTFTKYFIYWVRQAPGQGLEWL<br>GRIHPRTGAVKYAPRFQGRLSMTRDWSLDTAYLGLTGLTLGDTALYF<br>CARGAFEADSYGSSYPFHHWGQGTLVTVSSASTKGPSVFPLAPSSKST<br>SGGTAALGCLVKDYFPEPVTVSWNSGALTSGVHTFPAVLQSSGLYSLSS<br>VVTVPSSSLGTQTYICNVNHKPSNTKVDKKVEPKSCDKTHTCPPCPAPE<br>LLGGPSVFLFPPKPKDTLMISRTPEVTCVVVDVSHEDPEVKFNWYVDG<br>VEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIA<br>VEWESNGQPENNYKTTPPVLDSDGSFFLYSKLTVDKSRWQQGNVFSCS<br>VMHEALHNHYTQKSLSLSPGK<br>SEQ ID NO: 45<br>SWALTQPASVSASPGQSVTMSCTGFGNYNPDSWYQQYPGKAPKLIIYE<br>DNKRPSGVSDRFSASRLGSTSSLTISNVQAADDAHYVCASFEFFGGGTK<br>LTVLSQPKAAPSVTLFPPSSEELQANKATLVCLVSDFYPGAVTVAWKA<br>DGSPVKVGVETTKPSKQSNNKYAASSYLSLTPEQWKSHRSYSCRVTHE<br>GSTVEKTVAPAECS<br>SEQ ID NO: 46 |
| Sequence 24 | N49P53 | RVTLQQSGATVKQPGASVTVSCETSGYTFTKYTIHWVRQAPGQGLQW<br>VGRIHPRTGAVKYAPIFQGKVSMSRDLSRDTAYLGLTRLTLADTALFF<br>CARGAFEADLSGPTYPFHHWGQGTLVIVSAASTKGPSVFPLAPSSKST<br>SGGTAALGCLVKDYFPEPVTVSWNSGALTSGVHTFPAVLQSSGLYSLSS<br>VVTVPSSSLGTQTYICNVNHKPSNTKVDKKVEPKSCDKTHTCPPCPAPE<br>LLGGPSVFLFPPKPKDTLMISRTPEVTCVVVDVSHEDPEVKFNWYVDG<br>VEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIA<br>VEWESNGQPENNYKTTPPVLDSDGSFFLYSKLTVDKSRWQQGNVFSCS<br>VMHEALHNHYTQKSLSLSPGK<br>SEQ ID NO: 47<br>SWALTQPASVSASPGQSVTMSCTGFGNYNPDSWYQQYPGKAPKLIIYE<br>DNKRPSGVSNRFSASRLGSTSSLTISNVQAADDAHYVCASFEFFGGGTK<br>LIVLSQPKAAPSVTLFPPSSEELQANKATLVCLVSDFYPGAVTVAWKAD<br>GSPVKVGVETTKPSKQSNNKYAASSYLSLTPEQWKSHRSYSCRVTHEG<br>STVEKTVAPAECS<br>SEQ ID NO: 48 |
| Sequence 25 | N49P54 | NVQLMQSGTEVKKSGASVTISCETAGFNFIDSVIHWLRQAPGGGFQWM<br>GWIKPLRGAVNYPQFLQGRVSMTRDLSTDTVYMVLNGLTPDDTGLYY<br>CAKGAFRGGSPFGFWGQGTLLTVSPASTKGPSVFPLAPSSKSTSGGTA<br>ALGCLVKDYFPEPVTVSWNSGALTSGVHTFPAVLQSSGLYSLSSVVTVP<br>SSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHN<br>AKTKPREEQYNSTYRVVSVLTVLHQDWLNGKEYKCKVSNKALPAPIEK<br>TISKAKGQPREPQVYTLPPSRDELTKNQVSLTCLVKGFYPSDIAVEWES<br>NGQPENNYKTTPPVLDSDGSFFLYSKLTVDKSRWQQGNVFSCSVMHEA<br>LHNHYTQKSLSLSPGK<br>SEQ ID NO: 49<br>QSALSQPVSVSGSPGESITISCTGATTWYQQLPGRPPKLIIYDVTNRPSGI<br>SSRFSGSTSGHTASLTISGLQVDDEGLYHCASREFFGGGTKLTVLSQPK<br>AAPSVTLFPPSSEELQANKATLVCLVSDFYPGAVTVAWKADGSPVKVG<br>VETTKPSKQSNNKYAASSYLSLTPEQWKSHRSYSCRVTHEGSTVEKTV<br>APAECS<br>SEQ ID NO: 50 |
| Sequence 26 | N49P60 | QVRLVQSGPQVKKTGASVRVSCETSGYTFTSYFIHWLRLGPGEGLQW<br>MGWINPLHGAVNYENKFRGRVTITRDTSTDTVYLDMSRLTPDDTAVY<br>FCTRGIVADGWPYGHWGQGTQVTVSPASTKGPSVFPLAPSSKSTSGGT<br>AALGCLVKDYFPEPVTVSWNSGALTSGVHTFPAVLQSSGLYSLSSVVT<br>VPSSSLGTQTYICNVNHKPSNTKVDKKVEPKSCDKTHTCPPCPAPELLG<br>GPSVFLFPPKPKDTLMISRTPEVTCVVVDVSHEDPEVKFNWYVDGVEV<br>HNAKTKPREEQYNSTYRVVSVLTVLHQDWLNGKEYKCKVSNKALPAP<br>IEKTISKAKGQPREPQVYTLPPSRDELTKNQVSLTCLVKGFYPSDIAVEW<br>ESNGQPENNYKTTPPVLDSDGSFFLYSKLTVDKSRWQQGNVFSCSVMH<br>EALHNHYTQKSLSLSPGK<br>SEQ ID NO: 51<br>SWALTQPASVSGSPGQSVAISCAGGSVSWYQVLPGRAPKLIIYEGAKRP<br>SGVSARFSGSQSGNTAYLTISDLQTEDEGIYFCSSLQFFGGGTKLTVLSQ<br>PKAAPSVTLFPPSSEELQANKATLVCLVSDFYPGAVTVAWKADGSPVK |

-continued

| Natural antibody | Related variants | Amino Acid sequence |
|---|---|---|
| | | VGVETTKPSKQSNNKYAASSYLSLTPEQWKSHRSYSCRVTHEGSTVEK<br>TVAPAECS<br>SEQ ID NO: 52 |
| Sequence 27 | N49P61 | QVRLQQSGVVVRKPGASVRISCETSGFTFIDHIVHWVRRAPGRGFEWM<br>GWIKPLRGAVDYAPQLRGRISLTRDIYSETVFIDVSRLTSGDTAIYFCCK<br>AAAPEEAFPLQYWGQGTQLIVSSASTKGPSVFPLAPSSKSTSGGTAALG<br>CLVKDYFPEPVTVSWNSGALTSGVHTFPAVLQSSGLYSLSSVVTVPSSS<br>LGTQTYICNVNHKPSNTKVDKKVEPKSCDKTHTCPPCPAPELLGGPSVF<br>LFPPKPKDTLMISRTPEVTCVVVDVSHEDPEVKFNWYVDGVEVHNAKT<br>KPREEQYNSTYRVVSVLTVLHQDWLNGKEYKCKVSNKALPAPIEKTIS<br>KAKGQPREPQVYTLPPSRDELTKNQVSLTCLVKGFYPSDIAVEWESNG<br>QPENNYKTTPPVLDSDGSFFLYSKLTVDKSRWQQGNVFSCSVMHEALH<br>NHYTQKSLSLSPGK<br>SEQ ID NO: 53<br>QAALTQPASVSGSPGQSVTISCLYANVDICWYQLHPGRAPKLLIVDNNK<br>RPSGVSPRFSGSKSGTTASLTISGLQADDEAEYHCSSRTFFGGGTKLTVL<br>SQPKAAPSVTLFPPSSEELQANKATLVCLVSDFYPGAVTVAWKADGSP<br>VKVGVETTKPSKQSNNKYAASSYLSLTPEQWKSHRSYSCRVTHEGSTV<br>EKTVAPAECS<br>SEQ ID NO: 54 |
| Sequence 28 | N49P62 | QVRLQQSGVVVRKPGASVRLSCETSGFKFIDHIVNWVRRAPGRGFEW<br>MGWIKPLGGVADYAPQHRGRISLTRDIYTETVFIDLSRLTSGDTAIYFC<br>CKAAAPDEAFPLEYWGQGTQLIVSPASTKGPSVFPLAPSSKSTSGGTAA<br>LGCLVKDYFPEPVTVSWNSGALTSGVHTFPAVLQSSGLYSLSSVVTVPS<br>SSLGTQTYICNVNHKPSNTKVDKKVEPKSCDKTHTCPPCPAPELLGGPS<br>VFLFPPKPKDTLMISRTPEVTCVVVDVSHEDPEVKFNWYVDGVEVHNA<br>KTKPREEQYNSTYRVVSVLTVLHQDWLNGKEYKCKVSNKALPAPIEKT<br>ISKAKGQPREPQVYTLPPSRDELTKNQVSLTCLVKGFYPSDIAVEWESN<br>GQPENNYKTTPPVLDSDGSFFLYSKLTVDKSRWQQGNVFSCSVMHEAL<br>HNHYTQKSLSLSPGK<br>SEQ ID NO: 55<br>QAALTQPASVSGSPGQSVTISCLYANVDICWYQIQPGRLPKLLIVDNNR<br>RPSGVSPRFSGSKSGTTASLTISGLQADDEAEYHCSSTTFFGGGTKLTVL<br>SQPKAAPSVTLFPPSSEELQANKATLVCLVSDFYPGAVTVAWKADGSP<br>VKVGVETTKPSKQSNNKYAASSYLSLTPEQWKSHRSYSCRVTHEGSTV<br>EKTVAPAECS<br>SEQ ID NO: 56 |
| Sequence 29 | N49P63 | QVRLVQSGPVMRKPGASVRISCETSGFAFLDHIVHWVRRAPGRGFEW<br>MGWVKTIGGVVDYAPHLRGRISVTRDVFSETVFLDLSRLTSGDTAMYF<br>CSKAAAPDEAFPLEFWGQGTQVIVSSASTKGPSVFPLAPSSKSTSGGTA<br>ALGCLVKDYFPEPVTVSWNSGALTSGVHTFPAVLQSSGLYSLSSVVTVP<br>SSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHN<br>AKTKPREEQYNSTYRVVSVLTVLHQDWLNGKEYKCKVSNKALPAPIEK<br>TISKAKGQPREPQVYTLPPSRDELTKNQVSLTCLVKGFYPSDIAVEWES<br>NGQPENNYKTTPPVLDSDGSFFLYSKLTVDKSRWQQGNVFSCSVMHEA<br>LHNHYTQKSLSLSPGK<br>SEQ ID NO: 57<br>QAALTQPASVSGSPGQSVTISCLYANVDICWYQLHPGRAPKLLILDNNK<br>RPSGVSSRFSGSKSGTTASLTISDLQADDEAEYHCSSTTFFGGGTRLTVL<br>SQPKAAPSVTLFPPSSEELQANKATLVCLVSDFYPGAVTVAWKADGSP<br>VKVGVETTKPSKQSNNKYAASSYLSLTPEQWKSHRSYSCRVTHEGSTV<br>EKTVAPAECS<br>SEQ ID NO: 58 |
| Sequence 30 | N49P64 | QVRLVQSGPVVRKPGTSVRISCETSGFAFLDHIVHWVRRAPGRGFEWM<br>GWVKTIGGVVDYAPHLRGRISVTRDVFSEIVFMELSRLTSGDTAMYFC<br>SKAAAPDEAFPLEFWGQGTQVIVSSASTKGPSVFPLAPSSKSTSGGTAA<br>LGCLVKDYFPEPVTVSWNSGALTSGVHTFPAVLQSSGLYSLSSVVTVPS<br>SSLGTQTYICNVNHKPSNTKVDKKVEPKSCDKTHTCPPCPAPELLGGPS<br>VFLFPPKPKDTLMISRTPEVTCVVVDVSHEDPEVKFNWYVDGVEVHNA<br>KTKPREEQYNSTYRVVSVLTVLHQDWLNGKEYKCKVSNKALPAPIEKT<br>ISKAKGQPREPQVYTLPPSRDELTKNQVSLTCLVKGFYPSDIAVEWESN<br>GQPENNYKTTPPVLDSDGSFFLYSKLTVDKSRWQQGNVFSCSVMHEAL<br>HNHYTQKSLSLSPGK<br>SEQ ID NO: 59<br>QAALTQPASVSGSPGQSVTISCLYANVDICWYQLHPGRAPKLLIVDNNK<br>RPSGVSSRFSGSKSGTTASLTISDLQADDEAEYHCSSTTFFGGGTRLTVL<br>SQPKAAPSVTLFPPSSEELQANKATLVCLVSDFYPGAVTVAWKADGSP<br>VKVGVETTKPSKQSNNKYAASSYLSLTPEQWKSHRSYSCRVTHEGSTV<br>EKTVAPAECS<br>SEQ ID NO: 60 |

| Natural antibody | Related variants | Amino Acid sequence |
|---|---|---|
| Sequence 31 | N49P65 | QVQLVQSGAGVKKPGASVRVSCETSGFKFTEYFIHFLRQAPGQGLEW<br>MGWLNPLRGAVNYPRKFQGRVTLTRDIYTTTVYMQLNGLTPDDTAV<br>YYCARAVFNEAFPFDYWGQGSLVTVSSASTKGPSVFPLAPSSKSTSGG<br>TAALGCLVKDYFPEPVTVSWNSGALTSGVHTFPAVLQSSGLYSLSSVVT<br>VPSSSLGTQTYICNVNHKPSNTKVDKKVEPKSCDKTHTCPPCPAPELLG<br>GPSVFLFPPKPKDTLMISRTPEVTCVVVDVSHEDPEVKFNWYVDGVEVH<br>HNAKTKPREEQYNSTYRVVSVLTVLHQDWLNGKEYKCKVSNKALPAP<br>IEKTISKAKGQPREPQVYTLPPSRDELTKNQVSLTCLVKGFYPSDIAVEW<br>ESNGQPENNYKTTPPVLDSDGSFFLYSKLTVDKSRWQQGNVFSCSVMH<br>EALHNHYTQKSLSLSPGK<br>SEQ ID NO: 61<br>SWAQTQPASVSGSPGQSITISCAGIVSDAWYQQYPGRPPRLILYDGDKR<br>PSGVSPRFSASRAGKTASLTISGLQADDEAYYHCASREFFGGVTKLTVL<br>SQPKAAPSVTLFPPSSEELQANKATLVCLVSDFYPGAVTVAWKADGSP<br>VKVGVETTKPSKQSNNKYAASSYLSLTPEQWKSHRSYSCRVTHEGSTV<br>EKTVAPAECS<br>SEQ ID NO: 62 |
| Sequence 32 | N49P66 | QVRLQQSGVVVRKPGASVRLSCETSGFKFIDHIVNWVRRAPGRGFEW<br>MGWIKPLGGVADYAPQHRGRISLTRDIYTETVFIDLSRLTSGDTAIYFC<br>CKAAAPDEAFPLEYWGQGTQLIVSPASTKGPSVFPLAPSSKSTSGGTAA<br>LGCLVKDYFPEPVTVSWNSGALTSGVHTFPAVLQSSGLYSLSSVVTVPS<br>SSLGTQTYICNVNHKPSNTKVDKKVEPKSCDKTHTCPPCPAPELLGGPS<br>VFLFPPKPKDTLMISRTPEVTCVVVDVSHEDPEVKFNWYVDGVEVHNA<br>KTKPREEQYNSTYRVVSVLTVLHQDWLNGKEYKCKVSNKALPAPIEKT<br>ISKAKGQPREPQVYTLPPSRDELTKNQVSLTCLVKGFYPSDIAVEWESN<br>GQPENNYKTTPPVLDSDGSFFLYSKLTVDKSRWQQGNVFSCSVMHEAL<br>HNHYTQKSLSLSPGK<br>SEQ ID NO: 63<br>QAALTQPASVSGSPGQSVTISCLYANVDICWYQIQPGRLPKLLIVDNDR<br>RPSGVSPRFSGSKSGTTASLTISGLQADDEAEYHCSSTTFFGGGTKLTVL<br>SQPKAAPSVTLFPPSSEELQANKATLVCLVSDFYPGAVTVAWKADGSP<br>VKVGVETTKPSKQSNNKYAASSYLSLTPEQWKSHRSYSCRVTHEGSTV<br>EKTVAPAECS<br>SEQ ID NO: 64 |
| Sequence 33 | N49P67 | QVRLVQSGPVMRKPGASVRISCETSGFAFLDHIVHWVRRAPGRGFEW<br>MGWVKTIGGVVDYAPHLRGRISVTRDVFSETVFLDLSRLTSGDTAMYF<br>CSKAAAPDEAFPLEFWGQGTQVIVSSASTKGPSVFPLAPSSKSTSGGTA<br>ALGCLVKDYFPEPVTVSWNSGALTSGVHTFPAVLQSSGLYSLSSVVTVP<br>SSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHN<br>AKTKPREEQYNSTYRVVSVLTVLHQDWLNGKEYKCKVSNKALPAPIEK<br>TISKAKGQPREPQVYTLPPSRDELTKNQVSLTCLVKGFYPSDIAVEWES<br>NGQPENNYKTTPPVLDSDGSFFLYSKLTVDKSRWQQGNVFSCSVMHEA<br>LHNHYTQKSLSLSPGK<br>SEQ ID NO: 65<br>QAALTQPASVSGSPGQSVTISCLYANVDICWYQLHPGRAPKLLILDNNK<br>RPSGVSSRFSGSKSGTTASLTISDLQADDEAEYHCSSTTFFGGGTRLTVL<br>SQPKAAPSVTLFPPSSEELQANKATLVCLVSDFYPGAVTVAWKADGSP<br>VKVGVETTKPSKQSNNKYAASSYLSLTPEQWKSHRSYSCRVTHEGSTV<br>EKTVAPAECS<br>SEQ ID NO: 66 |
| Sequence 34 | N49P68 | HVQLRQSGTEAKKSGASVTISCETAGFNFIDSVIHWLRQAPGGGFQWM<br>GWIKPLRGGVNYPHYLQGRISMTRDLSSDTVYMVLNRLTPADTGLYY<br>CAKGAFGGSSPFGFWGQGTLLTVSPASTKGPSVFPLAPSSKSTSGGTA<br>ALGCLVKDYFPEPVTVSWNSGALTSGVHTFPAVLQSSGLYSLSSVVTVP<br>SSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHN<br>AKTKPREEQYNSTYRVVSVLTVLHQDWLNGKEYKCKVSNKALPAPIEK<br>TISKAKGQPREPQVYTLPPSRDELTKNQVSLTCLVKGFYPSDIAVEWES<br>NGQPENNYKTTPPVLDSDGSFFLYSKLTVDKSRWQQGNVFSCSVMHEA<br>LHNHYTQKSLSLSPGK<br>SEQ ID NO: 67<br>QSALSQPVSVSGSPGESITISCTEATTWYQQLPGKPPKLIIYDVTNRPSGI<br>SSRFSGSMSGRTASLTISGLQVDDEGLYHCASREFFGGGTKLTVLSQPK<br>AAPSVTLFPPSSEELQANKATLVCLVSDFYPGAVTVAWKADGSPVKVG<br>VETTKPSKQSNNKYAASSYLSLTPEQWKSHRSYSCRVTHEGSTVEKTV<br>APAECS<br>SEQ ID NO: 68 |
| Sequence 35 | N49P69 | HVQLMQSGTQAKKSGASVTISCETAGFKFIDSVIHWLRQAPGGGFQW<br>MGWIKPLGGAVNYPPYLQGRISLTRDLSTDTIYMVLNGLTPADTGFYY<br>CAKGAFGGSPFGFWGQGTLLTVSPASTKGPSVFPLAPSSKSTSGGTA<br>ALGCLVKDYFPEPVTVSWNSGALTSGVHTFPAVLQSSGLYSLSSVVTVP |

| Natural antibody | Related variants | Amino Acid sequence |
|---|---|---|
| | | SSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHN<br>AKTKPREEQYNSTYRVVSVLTVLHQDWLNGKEYKCKVSNKALPAPIEK<br>TISKAKGQPREPQVYTLPPSRDELTKNQVSLTCLVKGFYPSDIAVEWES<br>NGQPENNYKTTPPVLDSDGSFFLYSKLTVDKSRWQQGNVFSCSVMHEA<br>LHNHYTQKSLSLSPGK<br>SEQ ID NO: 69<br>QSALSQPVSVSGSPGDSITISCFGATTWYQQLPGRPPKLIIYDVTNRPSGI<br>SGRFSGSMSGQKASLTISGLQVDDEGLYHCASREFFGGGTKLTVLSQPK<br>AAPSVTLFPPSSEELQANKATLVCLVSDFYPGAVTVAWKADGSPVKVG<br>VETTKPSKQSNNKYAASSYLSLTPEQWKSHRSYSCRVTHEGSTVEKTV<br>APAECS<br>SEQ ID NO: 70 |
| Sequence 36 | N49P70 | HVQLRQSGTEAKKSGASVTISCETAGFNFIDSVIHWLRQAPGGGFQWM<br>GWIKPLRGGVNYPHYLQGRISMTRDLSSDTVYMVLNRLTPDDTGLYY<br>CAKGAFGGSSPFGFWGQGTLLTVSPASTKGPSVFPLAPSSKSTSGGTA<br>ALGCLVKDYFPEPVTVSWNSGALTSGVHTFPAVLQSSGLYSLSSVVTVP<br>SSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHN<br>AKTKPREEQYNSTYRVVSVLTVLHQDWLNGKEYKCKVSNKALPAPIEK<br>TISKAKGQPREPQVYTLPPSRDELTKNQVSLTCLVKGFYPSDIAVEWES<br>NGQPENNYKTTPPVLDSDGSFFLYSKLTVDKSRWQQGNVFSCSVMHEA<br>LHNHYTQKSLSLSPGK<br>SEQ ID NO: 71<br>QSALSQPVSVSGSPGESITISCTEATTWYQQLPGRSPKLIIYDVTNRPSGIS<br>SRFSGSMSGRTASLTISGLQVDDEGLYHCASREFFGGGTKLTVLSQPKA<br>APSVTLFPPSSEELQANKATLVCLVSDFYPGAVTVAWKADGSPVKVGV<br>ETTKPSKQSNNKYAASSYLSLTPEQWKSHRSYSCRVTHEGSTVEKTVAP<br>AECS<br>SEQ ID NO: 72 |
| Sequence 37 | N49P71 | RVTLQQSGATVRQPGASVTVSCETSGFTFIKYTIHWVRQAPGQGLQW<br>VGRIHPRTGAVKFAPIFQGKFSMSRDLSRDTAYLGLTRLTLADTALFFC<br>ARGAFEADLYGPTYPFHHWGQGTQVTVSAASTKGPSVFPLAPSSKSTS<br>GGTAALGCLVKDYFPEPVTVSWNSGALTSGVHTFPAVLQSSGLYSLSS<br>VVTVPSSSLGTQTYICNVNHKPSNTKVDKKVEPKSCDKTHTCPPCPAPE<br>LLGGPSVFLFPPKPKDTLMISRTPEVTCVVVDVSHEDPEVKFNWYVDG<br>VEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIA<br>VEWESNGQPENNYKTTPPVLDSDGSFFLYSKLTVDKSRWQQGNVFSCS<br>VMHEALHNHYTQKSLSLSPGK<br>SEQ ID NO: 73<br>SWALTQPASVSASPGQSVTMSCTGFGSYNPDSWYQQYPGKAPKLIIYD<br>DNKRPSGVSDRFSASRLGSTSSLTISNVQAADDAHYVCASFEFFGGGTK<br>LTVLSQPKAAPSVTLFPPSSEELQANKATLVCLVSDFYPGAVTVAWKA<br>DGSPVKVGVETTKPSKQSNNKYAASSYLSLTPEQWKSHRSYSCRVTHE<br>GSTVEKTVAPAECS<br>SEQ ID NO: 74 |
| Sequence 38 | N49P72 | HIQLLQSGPQVKKSGDTVRISCETSGYNFVDSLIHWVRQTPEKRLRWM<br>GWINPLQGGVNYAPEFQGRIRMTRDTFIDTVYVDLSGLTPADTAYYYC<br>ARGIDGNSYPFHFWGHGTRVTVFSASTKGPSVFPLAPSSKSTSGGTAAL<br>GCLVKDYFPEPVTVSWNSGALTSGVHTFPAVLQSSGLYSLSSVVTVPSS<br>SLGTQTYICNVNHKPSNTKVDKKVEPKSCDKTHTCPPCPAPELLGGPSV<br>FLFPPKPKDTLMISRTPEVTCVVVDVSHEDPEVKFNWYVDGVEVHNAK<br>TKPREEQYNSTYRVVSVLTVLHQDWLNGKEYKCKVSNKALPAPIEKTI<br>SKAKGQPREPQVYTLPPSRDELTKNQVSLTCLVKGFYPSDIAVEWESNG<br>QPENNYKTTPPVLDSDGSFFLYSKLTVDKSRWQQGNVFSCSVMHEALH<br>NHYTQKSLSLSPGK<br>SEQ ID NO: 75<br>RFALTQPASVSGSPGQTITITCAGGSVSWFHFPPGKTPRLIIYESSKRPSG<br>VSPRFSGSQSGSTASLIISGLQSDDEGTYFCSILEF**FGRGTLLTVLSQPKA<br>APSVTLFPPSSEELQANKATLVCLVSDFYPGAVTVAWKADGSPVKVGV<br>ETTKPSKQSNNKYAASSYLSLTPEQWKSHRSYSCRVTHEGSTVEKTVAP<br>AECS<br>SEQ ID NO:76 |

TABLE 2

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| Sequence 1 | N49P6, N49P6.2 N49P6-LS1 N49P6-LS2 N49P6A N49P6S N49P6F N49P6Y N49P6.54 TY | gcgggactgatgcagtctggggctgtgatgaagaattcgggggcctcagtgagggtctcttg tcaggctgatggatacgactttcattgactatgtcattcactggttttcgacaaagacgtggag aaggtcttgagtggctgggatggatgaatccctcggagggcggcacaaactatccgcgacca tttcagggcaaagtcaccatgaccagggacacgtccaccgagacagcctatttagatgtcag aggacttacatatgacgacacggccgtctattattgtgtgagagacagggccaacggttcgg gaagaagacgttttgagtcggtgaattggttcctggatctgtggggccgcggcacccaaata acagtcgtctcgccctccaccaagggcccatcggtcttcccctggcacctcctccaagag cacctctgggggcacagcggccctgggctgcctggtcaaggactacttccccgaaccggtga cggtgtcgtggaactcaggcgccctgaccagcggcgtgcacaccttcccggctgtcctacag tcctcaggactctactccctcagcagcgtggtgaccgtgccctccagcagcttgggcaccca gacctacatctgcaacgtgaatcacaagcccagcaacaccaaggtggacaagaaagttgagc ccaaatcttgtgacaaaactcacacatgcccaccgtgcccagcacctgaactcctgggggga ccgtcagtcttcctcttccccccaaaacccaaggacaccctcatgatctcccggacccctga ggtcacatgcgtggtggtggacgtgagccacgaagaccctgaggtcaagttcaactggtacg tggacggcgtggaggtgcataatgccaagacaaagccgcgggaggagcagtacaacagcacg taccgggtggtcagcgtcctcaccgtcctgcaccaggactggctgaatggcaaggagtacaa gtgcaaggtctccaacaaagccctcccagcccccatcgagaaaaccatctccaaagccaaag ggcagccccgagaaccacaggtgtacaccctgcccccatcccgggatgagctgaccaagaac caggtcagcctgacctgcctggtcaaaggcttctatcccagcgacatcgccgtggagtggga gagcaatgggcagccggagaacaactacaagaccacgcctcccgtgctggactccgacggct ccttcttcctctacagcaagctcaccgtggacaagagcaggtggcagcaggggaacgtcttc tcatgctccgtgatgcatgaggctctgcacaaccactacacgcagaagagcctctccctgtc tccgggtaaa SEQ ID NO: 77 |
| | | cagtctgccctaactcagcctcgctcagtgtccgcatctcctggtcagtcagtcaccatctc ctgcactggaacacacaattatgtgtcctggtgtcaacagaaaccgtgccaagccccaaat tattaatttacgatttcaataaaacggccctcaggggtctctgatcgcttctctggctccacg tctggcaacacggcctccctgaccatctctggactccaggctgacgatgagggtcattattt ttgttgggcgtttgaaaatatcggcggagggaccaagctgaccgtcctgcgtcagcccaagg ctgccccctcggtcactctgttcccgccctcctctgaggagcttcaagccaacaaggccaca ctggtgtgtctcataagtgacttctacccgggagccgtgacagtggcttggaaagcagatag cagcccgtcaaggcgggagtggagaccaccacaccctccaaacaaagcaacaacaagtacg cggccagcagctatctgagcctgacgcctgagcagtggaagtcccacagaagctacagctgc caggtcacgcatgaagggagcaccgtggagaagacagtggcccctacagaatgttca SEQ ID NO: 78 |
| Sequence 2 | N49P7, N49P7.1 N49P7A N49P7S N49P7F N49P7Y N49P7.54 TY N49P7-LS1 N49P7-LS2 N49P7/6L N49P7/11 L R49P7 | gcggacttggtgcagtctggggctgtggtgaagaagcctggggactcagtgaggatctcctg tgaggctcaaggatatagatttcctgactacatcattcactggatttcgacgggccctggac aaggccctgaatggatgggatggatgaatccaatgggcggacaagtaaatattccatggaaa tttcagggtagggtctccatgacccgggacacgtccatcgaaacagcatttctggacttaag aggactaaagtctgacgacacggccgtctattattgcgtgagagatcgcagtaatggatcgg gaaagcgattcgagtcctccaattggttcctcgatctgtggggccgtgggactgcggtcaca attcaatca tcctccaccaagggcccatcggtcttcccctggcacctcctccaagagcacctctggggg cacagcggccctgggctgcctggtcaaggactacttccccgaaccggtgacggtgtcgtgga actcaggcgccctgaccagcggcgtgcacaccttcccggctgtcctacagtcctcaggactc tactccctcagcagcgtggtgaccgtgccctccagcagcttgggcacccagacctcatctg caacgtgaatcacaagcccagcaacaccaaggtggacaagaaagttgagcccaaatcttgtg acaaaactcacacatgcccaccgtgcccagcacctgaactcctgggggaccgtcagtcttc ctcttccccccaaaacccaaggacaccctcatgatctcccggacccctgaggtcacatgcgt ggtggtggacgtgagccacgaagaccctgaggtcaagttcaactggtacgtggacggcgtgg aggtgcataatgccaagacaaagccgcgggaggagcagtacaacagcacgtaccgggtggtc agcgtcctcaccgtcctgcaccaggactggctgaatggcaaggagtacaagtgcaaggtctc caacaaagccctcccagcccccatcgagaaaaccatctccaaagccaaagggcagccccgag aaccacaggtgtacaccctgcccccatcccgggatgagctgaccaagaaccaggtcagcctg acctgcctggtcaaaggcttctatcccagcgacatcgccgtggagtgggagagcaatgggca gccggagaacaactacaagaccacgcctcccgtgctggactccgacggctccttcttcctct acagcaagctcaccgtggacaagagcaggtggcagcaggggaacgtcttctcatgctccgtg atgcatgaggctctgcacaaccactacacgcagaagagcctctccctgtctccgggtaaa SEQ ID NO: 79 |
| | | cagtctgccctgactcagcctcgctcagtgtccgcatctcctgggcagtccgtcaccatttc ctgcactggaacccacaatttggtctcttggtgtcaacatcaaccaggcagaccccaaat tattaatttatgacttcaataagaggccctcaggggtccctgatcgcttctctggctccggg tctggcggcacggcctccctgaccatcactggactccaggatgacgatgacgccgaatattt tgttgggcgtatgaagcttttggcggagggaccaagttgaccgttcttcgtcagcccaagg ctgccccctcggtcactctgttcccgccctcctctgaggagcttcaagccaacaaggccaca ctggtgtgtctcataagtgacttctacccgggagccgtgacagtggcttggaaagcagatag |

TABLE 2-continued

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| | | cagccccgtcaaggcgggagtggagaccaccacaccctccaaacaaagcaacaacaagtacg<br>cggccagcagctatctgagcctgacgcctgagcagtggaagtcccacagaagctacagctgc<br>caggtcacgcatgaaggagcaccgtggagaagacagtggcccctacagaatgttca<br>SEQ ID NO: 80 |
| Sequence 3 | N49P7.2 | gcggacttggtgcagtctggggctgtggtgaagaagcctggggactcagtgaggatctcctg<br>tgaggctcaaggatacaaatttcctgactacatcattcactggattcgacgggcccctggac<br>aaggccttgagtggatggggtggattaatccaatgggcggacaagtaaacattccatggcag<br>tttcagggcagggtctccatgacccgggacacgtccatcgaaacagcatttctggacttaag<br>aggactaaagtctgacgacacggccctctattattgcgtgagagatcgaagtaatggatcgg<br>gaaggcgattcgagtcctccaattggttcctcgatctgtgggccgcggcactgcggtcact<br>gttcattcaccctccaccaagggcccatcggtcttcccctggcaccctcctccaagagcac<br>ctctgggggcacagcggccctgggctgcctggtcaaggactacttccccgaaccggtgacgg<br>tgtcgtggaactcaggcgccctgaccagcggcgtgcacaccttcccggctgtcctacagtcc<br>tcaggactctactccctcagcagcgtggtgaccgtgccctccagcagcttgggcacccagac<br>ctacatctgcaacgtgaatcacaagcccagcaacaccaaggtggacaagaaagttgagccca<br>aatcttgtgacaaaactcacacatgcccaccgtgcccagcacctgaactcctgggggaccg<br>tcagtcttcctcttccccccaaaacccaaggacaccctcatgatctcccggacccctgaggt<br>cacatgcgtggtggtggacgtgagccacgaagacctgaggtcaagttcaactggtacgtgg<br>acggcgtggaggtgcataatgccaagacaaagccgcgggaggagcagtacaacagcacgtac<br>cgggtggtcagcgtcctcaccgtcctgcaccaggactggctgaatggcaaggagtacaagtg<br>caaggtctccaacaaagccctcccagccccatcgagaaaaccatctccaaagccaagggc<br>agccccgagaaccacaggtgtacaccctgcccccatcccgggatgagctgaccaagaac<br>gtcagcctgacctgcctggtcaaaggcttctatcccagcgacatcgccgtggagtgggagag<br>caatgggcagccggagaacaactacaagaccacgcctcccgtgctggactccgacggctcct<br>cttcctctacagcaagctcaccgtggacaagagcaggtggcagcaggggaacgtcttctca<br>tgctccgtgatgcatgaggctctgcacaaccactacacgcagaagagcctctccctgtctcc<br>gggtaaa<br>SEQ ID NO: 81 |
| | | cagtctgccctgactcagcctcgctcagtgtccgcatctcctgggcagtccgtcaccatttc<br>ctgcactggaacccacaatttggtctcttggtgtcaacatcacccaggcagagcccccaaat<br>tattaatttatgacttcaataagaggccctcaggggtccctgatcgcttctctggctccggg<br>tctggcggcacggcctcctgaccatcagtggactccaggatgacgatgacgccgaatattt<br>ttgttgggcgtatgaagcttttggcggagggaccaagttgaccgtacttcgtcagcccaagg<br>ctgccccctcggtcactctgttcccgccctcctctgaggagcttcaagccaacaaggccaca<br>ctggtgtgtctcataagtgacttctacccgggagccgtgacagtggcttggaaagcagatag<br>cagccccgtcaaggcgggagtggagaccaccacaccctccaaacaaagcaacaacaagtacg<br>cggccagcagctatctgagcctgacgcctgagcagtggaagtcccacagaagctacagctgc<br>caggtcacgcatgaaggagcaccgtggagaagacagtggcccctacagaatgttca<br>SEQ ID NO: 82 |
| Sequence 4 | N49P11 | tcggcggaattggtgcaatctggggctgtggtgaagaagcctgggacctccgtgaaggtctc<br>ttgtcaggcttatggatacacttttaccgactaccttattcattggcttcgacaggcccctg<br>gacaaggacttgaatggatgggatggatgaatcctgtttatggacaagtaaattatgcccaa<br>aactttcagggcagggtctccatgacccagggacatttacagggaaacagcatttctagaggt<br>gcgcgacctgaagactgacgacacaggcacttattattgtgtgagagacacaggcgacggtt<br>cgcggagacactttgactccatcaatttggtttctcgatcttttggggccgcgggacatggata<br>agggtcgccccagcctccaccaagggcccatcggtcttcccctggcaccctcctccaagag<br>cacctctgggggcacagcggccctgggctgcctggtcaaggactacttccccgaaccggtga<br>cggtgtcgtggaactcaggcgccctgaccagcggcgtgcacaccttcccggctgtcctacag<br>tcctcaggactctactccctcagcagcgtggtgaccgtgccctccagcagcttgggcacccag<br>acctacatctgcaacgtgaatcacaagcccagcaacaccaaggtggacaagaaagttgagc<br>ccaaatcttgtgacaaaactcacacatgcccaccgtgcccagcacctgaactcctgggggga<br>ccgtcagtcttcctcttccccccaaaacccaaggacaccctcatgatctcccggacccctga<br>ggtcacatgcgtggtggtggacgtgagccacgaagaccctgaggtcaagttcaactggtacg<br>tggacggcgtggaggtgcataatgccaagacaaagccgcgggaggagcagtacaacagcacg<br>taccgggtggtcagcgtcctcaccgtcctgcaccaggactggctgaatggcaaggagtacaa<br>gtgcaaggtctccaacaaagccctcccagccccatcgagaaaaccatctccaaagccaaag<br>ggcagccccgagaaccacaggtgtacaccctgcccccatcccgggatgagctgaccaagaac<br>caggtcagcctgacctgcctggtcaaaggcttctatcccagcgacatcgccgtggagtggga<br>gagcaatgggcagccggagaacaactacaagaccacgcctcccgtgctggactccgacggct<br>ccttcttcctctacagcaagctcaccgtggacaagagcaggtggcagcaggggaacgtcttc<br>tcatgctccgtgatgcatgaggctctgcacaaccactacacgcagaagagcctctccctgtc<br>tccgggtaaa<br>SEQ ID NO: 83 |
| | | cagtgtgtcttgactcagcctcgctcagtgtccggatctcctggacaatcagtcaccatctc<br>ctgcactggaactcacaattatgtctcctggtgtcaacaccacccaggcaacgccccaaat |

TABLE 2-continued

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| | | tattactttatgatttcgacaagcggccctcaggaatctctgatcgcttctctggctctagg<br>tctggcaacacggcctccctgaccatctctggcctccagcctgaggatgaggccgattactt<br>ttgttgggcctttgaagcctttggcggagggaccaaggtgctcgtccttcgtcagcccaagg<br>ctgcccctcggtcactctgttcccgccctcctctgaggagcttcaagccaacaaggccaca<br>ctggtgtgtctcataagtgacttctacccgggagccgtgacagtggcttggaaagcagatag<br>cagccccgtcaaggcgggagtggagaaccaccacacccctccaaacaaagcaacaacaagtacg<br>cggccagcagctatctgagcctgacgcctgagcagtggaagtcccacagaagctacagctgc<br>caggtcacgcatgaagggagcaccgtggagaagacagtggcccctacagaatgttca<br>SEQ ID NO: 84 |
| Sequence 5 | N49P18<br>N49P18.2 | gcggacttggtgcagtctggggctgtgatgaagaagcctggggactcagtgagaatctcctg<br>tgaggctcgaggatacacattcactgactacgtcattcactggattcgacgggcccctggac<br>aaggccttgaatggatggggtggattgatccacctttatggacaagtaaatattccatggaat<br>tttcagggcagggtctccatgacccgggacacgtccatcgaaacagcatttctggacttaag<br>aggtctaaagtctgacgacacgggcctctattattgcgtgagagatcgaagtaatggatggg<br>gaaagcgattcgagtcctccaattggttcctcgatctgtggggccgcggcactgtggtcact<br>gttcactcaccctccaccaagggcccatcggtcttcccctggcaccctcctccaagagcac<br>ctctgggggcacagcggccctgggctgcctggtcaaggactacttccccgaaccggtgacgg<br>tgtcgtggaactcaggcgccctgaccagcggcgtgcacaccttcccggctgtcctacagtcc<br>tcaggactctactccctcagcagcgtggtgaccgtgccctccagcagcttgggcacccagac<br>ctacatctgcaacgtgaatcacaagcccagcaacaccaaggtggacaagaaagttgagccca<br>aatcttgtgacaaaactcacacatgcccaccgtgcccagcacctgaactcctgggggggaccg<br>tcagtcttcctcttccccccaaaacccaaggacaccctcatgatctcccggacccctgaggt<br>cacatgcgtggtggtggacgtgagccacgaagaccctgaggtcaagttcaactggtacgtgg<br>acggcgtggaggtgcataatgccaagacaaagccgcgggaggagcagtacaacagcacgtac<br>cgggtggtcagcgtcctcaccgtcctgcaccaggactggctgaatggcaaggagtacaagtg<br>caaggtctccaacaaagccctcccagcccccatcgagaaaaccatctccaaagccaaagggc<br>agccccgagaaccacaggtgtacaccctgcccccatcccgggatgagctgaccaagaaccag<br>gtcagcctgacctgcctggtcaaaggcttctatcccagcgacatcgccgtggagtgggagag<br>caatgggcagccggagaacaactacaagaccacgcctcccgtgctggactccgacggctcct<br>tcttcctctacagcaagctcaccgtggacaagagcaggtggcagcaggggaacgtcttctca<br>tgctccgtgatgcatgaggctctgcacaaccactacacgcagaagagcctctccctgtctcc<br>gggtaaa<br>SEQ ID NO: 85 |
| | | cagtctgccctgactcagcctcgctcagtgtccgcatctcctgggcagtccgtcaccatttc<br>ctgcactggaacccacaatttggtctcttggtgtcaacatcacccaggcagagccccaagt<br>tattaatttatgacttcaataagaggccctcaggggtccctgatcgcttctctggctccggg<br>tctggcggcacggcctccctaaccatcagtggactccaggatgacgatgacgccgaatattt<br>ttgttgggcatatgaagctttcggcggagggaccaagttgactgtacttcgtcagcccaagg<br>ctgcccctcggtcactctgttcccgccctcctctgaggagcttcaagccaacaaggccaca<br>ctggtgtgtctcataagtgacttctacccgggagccgtgacagtggcttggaaagcagatag<br>cagccccgtcaaggcgggagtggagaaccaccacacccctccaaacaaagcaacaacaagtacg<br>cggccagcagctatctgagcctgacgcctgagcagtggaagtcccacagaagctacagctgc<br>caggtcacgcatgaagggagcaccgtggagaagacagtggcccctacagaatgttca<br>SEQ ID NO: 86 |
| Sequence 6 | N49P18.1 | gcggacttggtgcagtctggggctgtggtgaagaagcctggggactcagtgagaatctcctg<br>tgaggctcaaggatacacattcactgactacgtcattcactggattcgacgggcccctggac<br>aaggccttgaatggatggggtggattaatccaggttatggacaagtaaatattccatggaac<br>tttcagggcagggtctccatgacccgagacacgtccatcgaaacagcatttctggacttaag<br>aggtctaaagtctgacgacacgggcctctattattgcgtgagagatcgaagtaatggatggg<br>gaaagcgattcgagtcctccaattggttcctcgatctgtggggccgcggcactgtggtcact<br>gttcactcaccctccaccaagggcccatcggtcttcccctggcaccctcctccaagagcac<br>ctctgggggcacagcggccctgggctgcctggtcaaggactacttccccgaaccggtgacgg<br>tgtcgtggaactcaggcgccctgaccagcggcgtgcacaccttcccggctgtcctacagtcc<br>tcaggactctactccctcagcagcgtggtgaccgtgccctccagcagcttgggcacccagac<br>ctacatctgcaacgtgaatcacaagcccagcaacaccaaggtggacaagaaagttgagccca<br>aatcttgtgacaaaactcacacatgcccaccgtgcccagcacctgaactcctgggggggaccg<br>tcagtcttcctcttccccccaaaacccaaggacaccctcatgatctcccggacccctgaggt<br>cacatgcgtggtggtggacgtgagccacgaagaccctgaggtcaagttcaactggtacgtgg<br>acggcgtggaggtgcataatgccaagacaaagccgcgggaggagcagtacaacagcacgtac<br>cgggtggtcagcgtcctcaccgtcctgcaccaggactggctgaatggcaaggagtacaagtg<br>caaggtctccaacaaagccctcccagcccccatcgagaaaaccatctccaaagccaaagggc<br>agccccgagaaccacaggtgtacaccctgcccccatcccgggatgagctgaccaagaaccag<br>gtcagcctgacctgcctggtcaaaggcttctatcccagcgacatcgccgtggagtgggagag<br>caatgggcagccggagaacaactacaagaccacgcctcccgtgctggactccgacggctcct<br>tcttcctctacagcaagctcaccgtggacaagagcaggtggcagcaggggaacgtcttctca<br>tgctccgtgatgcatgaggctctgcacaaccactacacgcagaagagcctctccctgtctcc |

TABLE 2-continued

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| | | gggtaaa<br>SEQ ID NO: 87 |
| | | cagtctgccctgactcagcctcgctcaatgtccgcatctcctgggcagtccgtcaccatttc<br>ctgcactggaacccacaatttggtctcttggtgtcaacatcacccaggcagacccccaaat<br>tattaatttatgacttcaataagaggccctcaggggtccctgatcgcttctctggctccggg<br>tctggcggcacggcctccctgaccatcagtggactccaggatgacgatgacgccgaatacat<br>ttgttgggcatatgaagctttcggcggagggaccaagttgaccgtacttcgtcagcccaagg<br>ctgcccctcggtcactctgttcccgcctcctctgaggagcttcaagccaacaaggccaca<br>ctggtgtgtctcataagtgacttctacccgggagccgtgacagtggcttggaaagcagatag<br>cagcccgtcaaggcgggagtggagaccaccacaccctccaaacaaagcaacaacaagtacg<br>cggccagcagctatctgagcctgacgcctgagcagtggaagtcccacagaagctacagctgc<br>caggtcacgcatgaagggagcaccgtggagaagacagtggcccctacagaatgttca<br>SEQ ID NO: 88 |
| Sequence 7 | N49P19 | gcggacttggtgcagtctggggctgtggtgaaaaatgctggggcctcagtgagggtctcctg<br>tgaggcttatggatacacattcgtggactacttcattcattgggtccgacaggcccctggac<br>aaggctttgaatggatgggatacatggatggtccgcagtgggcgcccaaacattgcgcgaaaa<br>tttcagggcaggctctccctgagtcgagataggtccagcgaaacttcatttctggacttaag<br>tggactgaggtctgacgactcggccgtctattattgtgtgagagacaagagtaatggatcgg<br>gcagacggtttgactcgtctaattggtttctcgatctgtggggccgtggaacccgggtcagt<br>attttctcagcctccaccaagggcccatcggtcttccccctggcaccctcctccaagagcac<br>ctctgggggcacagcggccctgggctgcctggtcaaggactacttccccgaaccggtgacgg<br>tgtcgtggaactcaggcgccctgaccagcggcgtgcacaccttcccggctgtcctacagtcc<br>tcaggactctactccctcagcagcgtggtgaccgtgccctccagcagcttgggcacccagac<br>ctacatctgcaacgtgaatcacaagcccagcaacaccaaggtggacaagaaagttgagccca<br>aatcttgtgacaaaactcacacatgcccaccgtgcccagcacctgaactcctgggggggaccg<br>tcagtcttcctcttccccccaaaacccaaggacaccctcatgatctcccggacccctgaggt<br>cacatgcgtggtggtggacgtgagccacgaagaccctgaggtcaagttcaactggtacgtgg<br>acggcgtggaggtgcataatgccaagacaaagccgcgggaggagcagtacaacagcacgtac<br>cgggtggtcagcgtcctcaccgtcctgcaccaggactggctgaatggcaaggagtacaagtg<br>caaggtctccaacaaagccctcccagcccccatcgagaaaaccatctccaaagccaaagggc<br>agccccgagaaccacaggtgtacaccctgcccccatcccgggatgagctgaccaagaaccag<br>gtcagcctgacctgcctggtcaaaggcttctatcccagcgacatcgccgtggagtgggagag<br>caatgggcagccggagaacaactacaagaccacgcctcccgtgctggactccgacggctcct<br>tcttcctctacagcaagctcaccgtggacaagagcaggtggcagcaggggaacgtcttctca<br>tgctccgtgatgcatgaggctctgcacaaccactacacgcagaagagcctctccctgtctcc<br>gggtaaa<br>SEQ ID NO: 89 |
| | | cagtctgccctgactcagcctcgctcagtgtccgcaactcctggacagtcagtcaccatctc<br>ctgcactggaacccacaattatgtctcttggtgtcaacaacatccaggcagagcccccaaat<br>tactaatttatgacttcaataagaggccctcaggggtcccggatcgcttctctggctccgga<br>tctggcggcacggcctccctaaccatcactggactccaggatgacgatgaagcggactattt<br>ttgttgggcctatgatgctttggcggagggaccaagttgaccgtcctgcgtcagcccaagg<br>ctgcccctcggtcactctgttcccgcctcctctgaggagcttcaagccaacaaggccaca<br>ctggtgtgtctcataagtgacttctacccgggagccgtgacagtggcttggaaagcagatag<br>cagcccgtcaaggcgggagtggagaccaccacaccctccaaacaaagcaacaacaagtacg<br>cggccagcagctatctgagcctgacgcctgagcagtggaagtcccacagaagctacagctgc<br>ccaggtacgcatgaagggagcaccgtggagaagacagtggcccctacagaatgttca<br>SEQ ID NO: 90 |
| Sequence 8 | N49P37 | gcggacttggtgcagtctggggctgtggtgaagaagcctggggactcagtgagggtctcctg<br>tgaggcttatggatacacattcagtgactacatcattcattggattcgacgggcccctggac<br>gaggccttgaatggatgggatggatgaatccgatgggcggacaagtgaatattccgtggaac<br>tttcagggagagtctccatgacccgggacacgtccatcgaaacagcatttctggacttaag<br>aggactgaggtctgacgacacggccgtctattactgtgtgagagatcgcagcaatggatcgg<br>gcaagcgatttgagtcctccaattggttcctcgatctgtggggccgcgggaccgcggtcact<br>atttcctcaccctccaccaagggcccatcggtcttccccctggcaccctcctccaagagcac<br>ctctgggggcacagcggccctgggctgcctggtcaaggactacttccccgaaccggtgacgg<br>tgtcgtggaactcaggcgccctgaccagcggcgtgcacaccttcccggctgtcctacagtcc<br>tcaggactctactccctcagcagcgtggtgaccgtgccctccagcagcttgggcacccagac<br>ctacatctgcaacgtgaatcacaagcccagcaacaccaaggtggacaagaaagttgagccca<br>aatcttgtgacaaaactcacacatgcccaccgtgcccagcacctgaactcctgggggaccg<br>tcagtcttcctcttccccccaaaacccaaggacaccctcatgatctcccggacccctgaggt<br>cacatgcgtggtggtggacgtgagccacgaagaccctgaggtcaagttcaactggtacgtgg<br>acggcgtggaggtgcataatgccaagacaaagccgcgggaggagcagtacaacagcacgtac<br>cgggtggtcagcgtcctcaccgtcctgcaccaggactggctgaatggcaaggagtacaagtg<br>caaggtctccaacaaagccctcccagcccccatcgagaaaaccatctccaaagccaaagggc |

TABLE 2-continued

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| | | agccccgagaaccacaggtgtacaccctgcccccatcccgggatgagctgaccaagaaccag gtcagcctgacctgcctggtcaaaggcttctatcccagcgacatcgccgtggagtgggagag caatgggcagccggagaacaactacaagaccacgcctcccgtgctggactccgacggctcct tcttcctctacagcaagctcaccgtggacaagagcaggtggcagcaggggaacgtcttctca tgctccgtgatgcatgaggctctgcacaaccactacacgcagaagagcctctccctgtctcc gggtaaa<br>SEQ ID NO: 91 |
| | | cagtctgccctgactcagcctcgctcagtgtccgcagctcctggacagtccgtcaccatttc ctgcactggaacccacaatttggtttcttggtgtcaacatcaccaggcagagccccccaagt tattaatttatgacttcaataagagaccctcaggtgtccctgatcgtttctctggctccggg tctggcggcacggcctccctaaccatcactggactccaggatgacgatgaggctgaatattt ttgttgggcgtatgaagtttttggcggagggaccaagttgaccgtgcttcgtcagcccaagg ctgcccctcggtcactctgttcccgcccctcctctgaggagcttcaagccaacaaggccaca ctggtgtgtctcataagtgacttctacccgggagccgtgacagtggcttggaaagcagatag cagcccgtcaaggcgggagtggagaccaccacaccctccaaacaaagcaacaacaagtacg cggccagcagctatctgagcctgacgcctgagcagtggaagtcccacagaagctacagctgc caggtcacgcatgaaggagcaccgtggagaagacagtggcccctacagaatgttca<br>SEQ ID NO: 92 |
| Sequence 9 | N49P38<br>N49P38.1 | gcggacttggtgcagtctggggctgtggtgaagacgcctggggcctcagtgagggtctcctg tgaggcttatggatacacattcattgactacatcattcattgggtccgacaggcccctggac aaggttttgaatggctgggatacatcgatcctatgaacgggcgccaaacattgcgcgaaaa tttcagggcaggctctccctgagccgggatacgtccatcgaaacatcatttctggacttaag tggactgaggtctgacgactcggccgtctattattgtgtgagagacaagagtaatggatcgg gcaaacgatttgactcctctaattggtttctcgatctgtggggccgtggaacgcgggtcagc atttcttcagcctccaccaagggcccatcggtcttcccccctggcaccctcctccaagagcac ctctgggggcacagcggccctgggctgcctggtcaaggactacttccccgaaccggtgacgg tgtcgtggaactcaggcgccctgaccagcggcgtgcacaccttcccggctgtcctacagtcc tcaggactctactccctcagcagcgtggtgaccgtgccctccagcagcttgggcacccagac ctacatctgcaacgtgaatcacaagcccagcaacaccaaggtggacaagaaagttgagccca aatcttgtgacaaaactcacacatgcccaccgtgcccagcacctgaactcctgggggaccg tcagtcttcctcttccccccaaaacccaaggacaccctcatgatctcccggacccctgaggt cacatgcgtggtggtggacgtgagccacgaagaccctgaggtcaagttcaactggtacgtgg acggcgtggaggtgcataatgccaagacaaagccgcgggaggagcagtacaacagcacgtac cgggtggtcagcgtcctcaccgtcctgcaccaggactggctgaatggcaaggagtacaagtg caaggtctccaacaaagccctcccagcccccatcgagaaaaccatctccaaagccaagggc agccccgagaaccacaggtgtacaccctgcccccatcccgggatgagctgaccaagaaccag gtcagcctgacctgcctggtcaaaggcttctatcccagcgacatcgccgtggagtgggagag caatgggcagccggagaacaactacaagaccacgcctcccgtgctggactccgacggctcct tcttcctctacagcaagctcaccgtggacaagagcaggtggcagcaggggaacgtcttctca tgctccgtgatgcatgaggctctgcacaaccactacacgcagaagagcctctccctgtctcc gggtaaa<br>SEQ ID NO: 93 |
| | | cagtctgccctgactcagcctcgctcagtgtccgcagctcctggacagtcagtcaccatctc ctgcactggaacccacaatttatgtctcttggtgtcaacaacatccaggcagagccccaaat tactaatttatgacttcaataagagccctcaggggtcccggatcgcttctctggctccgga tctggcggcacggcctccctaaccatcactagactccaggatgacgatgacgctgactattt ttgttgggcgtatgatgcttttggcggagggaccaagttgaccgtcctgcgtcagcccaagg ctgcccctcggtcactctgttcccgcccctcctctgaggagcttcaagccaacaaggccaca ctggtgtgtctcataagtgacttctacccgggagccgtgacagtggcttggaaagcagatag cagcccgtcaaggcgggagtggagaccaccacaccctccaaacaaagcaacaacaagtacg cggccagcagctatctgagcctgacgcctgagcagtggaagtcccacagaagctacagctgc caggtcacgcatgaaggagcaccgtggagaagacagtggcccctacagaatgttca<br>SEQ ID NO: 94 |
| Sequence 10 | N49P55 | gcggacttggtgcagtctggggctgtggtgaagaagcctggggcctcagtgagggtctcctg tgaggcttatggatacacattcactgactacatcattcattggattcgacaggcccctggac aaggccttgaatggatgggatggatgaatcctatgggcgggcgcacaaatattccgtggaaa tttcagggcagggtctccatgacccgggacacgtccatcgaaacagcatttctggacttaag tggactaacgtctgacgacacggccgtctattattgcgtgagagacaagagtaatggatcgg gcaaacgatttgactcctctaattggttcctcgatctgtggggccgcggaacccggtcact atttcctcaccctccaccaagggcccatcggtcttcccccctggcaccctcctccaagagcac ctctgggggcacagcggccctgggctgcctggtcaaggactacttccccgaaccggtgacgg tgtcgtggaactcaggcgccctgaccagcggcgtgcacaccttcccggctgtcctacagtcc tcaggactctactccctcagcagcgtggtgaccgtgccctccagcagcttgggcacccagac ctacatctgcaacgtgaatcacaagcccagcaacaccaaggtggacaagaaagttgagccca aatcttgtgacaaaactcacacatgcccaccgtgcccagcacctgaactcctgggggaccg |

TABLE 2-continued

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| | | tcagtcttcctcttcccccaaaacccaaggacaccctcatgatctcccggacccctgaggt cacatgcgtggtggtggacgtgagccacgaagaccctgaggtcaagttcaactggtacgtgg acggcgtggaggtgcataatgccaagacaaagccgcggggaggagcagtacaacagcacgtac cggggtggtcagcgtcctcaccgtcctgcaccaggactggctgaatggcaaggagtacaagtg caaggtctccaacaaagcccttcccagcccccatcgagaaaaccatctccaaagccaaagggc agccccgagaaccacaggtgtacaccctgcccccatcccgggatgagctgaccaagaaccag gtcagcctgacctgcctggtcaaaggcttctatcccagcgacatcgccgtggagtgggagag caatgggcagccggagaacaactacaagaccacgcctcccgtgctggactccgacggctcct tcttcctctacagcaagctcaccgtggacaagagcaggtggcagcaggggaacgtcttctca tgctccgtgatgcatgaggctctgcacaaccactacacgcagaagagcctctccctgtctcc gggtaaa<br>SEQ ID NO: 95 |
| | | cagtctgccctgactcagcctcgctcagtgtccgcagctcctggacagtccgtcaccatttc ctgcactggaacccacaatttggtctcttggtgtcaacaacacccaggcagagcccccaaat tattaatttatgacttcaataagaggccctcaggggtccctgatcgcttctctggctccggg tctggcggcacggcctccctaagtatcactggactccaggatgacgatgaagctgaatattt ttgttgggcgtatgaagcttttggcggagggaccaagttgaccgtccttcgtcagcccaagg ctgcccctcggtcactctgttcccgccctcctctgaggagcttcaagccaacaaggccaca ctggtgtgtctcataagtgacttctacccgggagccgtgacagtggcttggaaagcagatag cagccccgtcaaggcgggagtggagaccaccacaccctccaaacaaagcaacaacaagtacg cggccagcagctatctgagcctgacgcctgagcagtggaagtcccacagaagctacagctgc caggtcacgcatgaagggagcaccgtggagaagacagtggcccctacagaatgttca<br>SEQ ID NO: 96 |
| Sequence 11 | N49P56 | gcggacttggtgcagtctggggctgtggtgaagaagcctggggcctcagtgcgggtctcctg tgaggcttatggatatacattcgttgactacctcattcattgggtccgacaggccccggac aaggttttgaatggatgggatacatggatcctatgaacgggcgcccaaatattgcgcgaaaa tttcagggcaggctctccctgagccgagatacgtccatcgaaacatcatttctggacttaag tggactgaggtctgacgactcggccgtctattattgtgtgagagacaagagtggtggatcgg gcaaactatttgactcctctaattggtttctcgatctgtggggccgtggaacccgggtcagc atttcttcagcctccaccaagggcccatcggtcttccccctggcaccctcctccaagagcac ctctgggggcacagcggccctgggctgcctggtcaaggactacttccccgaaccggtgacgg tgtcgtggaactcaggcgccctgaccagcggcgtgcacaccttcccggctgtcctacagtcc tcaggactctactccctcagcagcgtggtgaccgtgccctccagcagcttgggcacccagac ctacatctgcaacgtgaatcacaagcccagcaacaccaaggtggacaagaaagttgagccca aatcttgtgacaaaactcacacatgcccaccgtgcccagcacctgaactcctgggggaccg tcagtcttcctcttcccccaaaacccaaggacaccctcatgatctcccggacccctgaggt cacatgcgtggtggtggacgtgagccacgaagaccctgaggtcaagttcaactggtacgtgg acggcgtggaggtgcataatgccaagacaaagccgcggggaggagcagtacaacagcacgtac cggggtggtcagcgtcctcaccgtcctgcaccaggactggctgaatggcaaggagtacaagtg caaggtctccaacaaagcccttcccagcccccatcgagaaaaccatctccaaagccaaagggc agccccgagaaccacaggtgtacaccctgcccccatcccgggatgagctgaccaagaaccag gtcagcctgacctgcctggtcaaaggcttctatcccagcgacatcgccgtggagtgggagag caatgggcagccggagaacaactacaagaccacgcctcccgtgctggactccgacggctcct tcttcctctacagcaagctcaccgtggacaagagcaggtggcagcaggggaacgtcttctca tgctccgtgatgcatgaggctctgcacaaccactacacgcagaagagcctctccctgtctcc gggtaaa<br>SEQ ID NO: 97 |
| | | cagtctgccctgactcagcctcgctcagtgtccgcagctcctggacagtcagtcaccatctc ctgcaccggaactcacaattatgtctcttggtgtcaacaacatccaggcagagccccaaat tactaatttatgacttcaataagaggccctcaggggtcccggatcgcttctctggctccgga tctggcggcacggcctccctaaccatcactggactccaggatgacgatgacgctgattattt ttgttgggcgtatgatgcttttggcggagggaccaagttgaccgtcctgcgtcagcccaagg ctgcccctcggtcactctgttcccgccctcctctgaggagcttcaagccaacaaggccaca ctggtgtgtctcataagtgacttctacccgggagccgtgacagtggcttggaaagcagatag cagccccgtcaaggcgggagtggagaccaccacaccctccaaacaaagcaacaacaagtacg tcggccagcagctatctgagcctgacgcctgagcagtggaagtcccacagaagctacagctgc cagcgtcacgcatgaagggagcaccgtggagaagacagtggcctacagaatgttca<br>SEQ ID NO: 98 |
| Sequence 12 | N49P57 | gcggacttggtgcagtctggggctgtggtgaagaagcctggggactcagtgagaatctcctg tgaggctcaaggatacacattcactgactacgtcattcactggattcgacaggcccctcagc aaggccttgaatggatggggtggattaatccaggttatggacaagtaaatattccatggaac tttcagggcagggtctccatgacccgagacacgtccatcgaaacagcttttctggagttaag aggtctaaagtctgacgacacgggcctctattattgcgtgagagatcgaagtaatggatggg gaaagcgattcgagtcctccaattggttcctcgatctgtggggccgcggcactgtgattact gttcactcacccctccaccaagggcccatcggtcttcccctggcaccctcctccaagagcac |

TABLE 2-continued

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| | | ctctgggggcacagcggccctgggctgcctggtcaaggactacttccccgaaccggtgacgg<br>tgtcgtggaactcaggcgccctgaccagcggcgtgcacaccttcccggctgtcctacagtcc<br>tcaggactctactccctcagcagcgtggtgaccgtgccctccagcagcttgggcacccagac<br>ctacatctgcaacgtgaatcacaagcccagcaacaccaaggtggacaagaaagttgagccca<br>aatcttgtgacaaaactcacacatgcccaccgtgcccagcacctgaactcctgggggaccg<br>tcagtcttcctcttccccccaaaacccaaggacaccctcatgatctcccggacccctgaggt<br>cacatgcgtggtggtggacgtgagccacgaagaccctgaggtcaagttcaactggtacgtgg<br>acggcgtggaggtgcataatgccaagacaaagccgcggggaggagcagtacaacagcacgtac<br>cgggtggtcagcgtcctcaccgtcctgcaccaggactggctgaatggcaaggagtacaagtg<br>caaggtctccaacaaagcccctcccagcccccatcgagaaaaccatctccaaagccaaagggc<br>agccccgagaaccacaggtgtacaccctgcccccatcccgggatgagctgaccaagaaccag<br>gtcagcctgacctgcctggtcaaaggcttctatcccagcgacatcgccgtggagtgggagag<br>caatgggcagccggagaacaactacaagaccacgcctcccgtgctggactccgacggctcct<br>tcttcctctacagcaagctcaccgtggacaagagcaggtggcagcaggggaacgtcttctca<br>tgctccgtgatgcatgaggctctgcacaaccactacacgcagaagagcctctccctgtctcc<br>gggtaaa<br>SEQ ID NO: 99 |
| | | cagtctgccctgactcagcctcgctcaatgtccgcatctcctgggcagtccgtcaccatttc<br>ctgcactggaacccacaatttggtctcttggtgtcaacatcacccaggcagaccccccaaat<br>tattaatttatgacttcaataagaggccctcaggggtccctgatcgcttctctggctccggg<br>tctggcggcacggcctcctgaccatcactggactccaggatgacgatgacgccgaatacat<br>ttgttgggcatatgaagctttcggcggagggaccaagttgaccatacttcgtcagcccaagg<br>ctgccccctcggtcactctgttcccgccctcctctgaggagcttcaagccaacaaggccaca<br>ctggtgtgtctcataagtgacttctacccgggagccgtgacagtggcttggaaagcagatag<br>cagcccgtcaaggcgggagtggagaccaccacaccctccaaacaaagcaacaacaagtacg<br>cggccagcagctatctgagcctgacgcctgagcagtggaagtcccacagaagctacagctgc<br>caggtcacgcatgaagggagcaccgtggagaagacagtggcccctacagaatgttca<br>SEQ ID NO: 100 |
| Sequence 13 | N49P58 | gcggacttggtgcagtctggggctgtggtgaagaagcctggggactcagtgagaatctcctg<br>tgaggctcagggatatacattcaccgactacgtcattcattggattcgacgggcccctggac<br>aaggccttgaatggatgggtggatggatccaagttatggacaagtcaatattccacggaac<br>tttcagggcagggtctccatgacccgggacacgttcagggaaacagcatatctggaattaag<br>aggtctacagtctgacgacaagggcctctattattgtgtggagatcgaagtcacggatcgg<br>gaaggcaattcgagtcctccaactggttcctcgatctgtggggccgcggcactgtggtcaat<br>gttcagtcacccctccaccaagggcccatcggtcttcccccctggcaccctcctccaagagcac<br>ctctgggggcacagcggccctgggctgcctggtcaaggactacttccccgaaccggtgacgg<br>tgtcgtggaactcaggcgccctgaccagcggcgtgcacaccttcccggctgtcctacagtcc<br>tcaggactctactccctcagcagcgtggtgaccgtgccctccagcagcttgggcacccagac<br>ctacatctgcaacgtgaatcacaagcccagcaacaccaaggtggacaagaaagttgagccca<br>aatcttgtgacaaaactcacacatgcccaccgtgcccagcacctgaactcctgggggaccg<br>tcagtcttcctcttccccccaaaacccaaggacaccctcatgatctcccggacccctgaggt<br>cacatgcgtggtggtggacgtgagccacgaagaccctgaggtcaagttcaactggtacgtgg<br>acggcgtggaggtgcataatgccaagacaaagccgcggggaggagcagtacaacagcacgtac<br>cgggtggtcagcgtcctcaccgtcctgcaccaggactggctgaatggcaaggagtacaagtg<br>caaggtctccaacaaagcccctcccagcccccatcgagaaaaccatctccaaagccaaagggc<br>agccccgagaaccacaggtgtacaccctgcccccatcccgggatgagctgaccaagaaccag<br>gtcagcctgacctgcctggtcaaaggcttctatcccagcgacatcgccgtggagtgggagag<br>caatgggcagccggagaacaactacaagaccacgcctcccgtgctggactccgacggctcct<br>tcttcctctacagcaagctcaccgtggacaagagcaggtggcagcaggggaacgtcttctca<br>tgctccgtgatgcatgaggctctgcacaaccactacacgcagaagagcctctccctgtctcc<br>gggtaaa<br>SEQ ID NO: 101 |
| | | cagtctgccctgactcagcctcgctcagtgtccgcatctcctgggcagtccgtcaccatttc<br>ctgcactggaacccacaatttggtctcttggtgtcaacatcacccaggcagacctcccaaat<br>tattaatttatgacttcaataagagggcttcaggggtccctgatcgcttctctggctccggg<br>tctggcggcacggcctcctgaccattagtggactccaggatgacgatgacgccgaatattt<br>ttgttgggcatatgaagctttcggcggagggaccaagttgaccgtacttcgtcagcccaagg<br>ctgccccctcggtcactctgttcccgccctcctctgaggagcttcaagccaacaaggccaca<br>ctggtgtgtctcataagtgacttctacccgggagccgtgacagtggcttggaaagcagatag<br>cagcccgtcaaggcgggagtggagaccaccacaccctccaaacaaagcaacaacaagtacg<br>cggccagcagctatctgagcctgacgcctgagcagtggaagtcccacagaagctacagctgc<br>caggtcacgcatgaagggagcaccgtggagaagacagtggcccctacagaatgttca<br>SEQ ID NO: 102 |

TABLE 2-continued

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| Sequence 14 | N49P59 | gcggacttggtgcagtctggggctgtggtgaagaagcctggggactcactgagaatctcctg<br>tgaggctcaaggatacacattcactgactacgtcattcactggattcgacgggcccctggac<br>aaggccttgaatggatgggatggatggatccaagttttggacaaatgaacattccacggaac<br>tttcagggcagggtctccatgacccgtgacatgtacatcgaaacagcatttctggacttaag<br>aggtctaaagtctgacgacacgggcctctattattgcgtgagagatcgaagtcatggatcgg<br>gaaggctattcgagtcctccaattggttcctcgatctgtggggccgcggcactgtggtcact<br>gttcagtcaccctccaccaagggcccatcggtcttcccctggcaccctcctccaagagcac<br>ctctgggggcacagcggccctgggctgcctggtcaaggactacttccccgaaccggtgacgg<br>tgtcgtggaactcaggcgccctgaccagcggcgtgcacaccttcccggctgtcctacagtcc<br>tcaggactctactccctcagcagcgtggtgaccgtgccctccagcagcttgggcacccagac<br>ctacatctgcaacgtgaatcacaagcccagcaacaccaaggtggacaagaaagttgagccca<br>aatcttgtgacaaaactcacacatgcccaccgtgcccagcacctgaactcctgggggaccg<br>tcagtcttcctcttccccccaaaacccaaggacaccctcatgatctcccggacccctgaggt<br>cacatgcgtggtggtggacgtgagccacgaagacctgaggtcaagttcaactggtacgtgg<br>acggcgtggaggtgcataatgccaagacaaagccgcggggaggagcagtacaacagcacgtac<br>cgggtggtcagcgtcctcaccgtcctgcaccaggactggctgaatggcaaggagtacaagtg<br>caaggtctccaacaaagcccctcccagcccccatcgagaaaaccatctccaaagccaaagggc<br>agccccgagaaccacaggtgtacaccctgcccccatcccgggatgagctgaccaagaaccag<br>gtcagcctgacctgcctggtcaaaggcttctatcccagcgacatcgccgtggagtgggagag<br>caatgggcagccggagaacaactacaagaccacgcctcccgtgctggactccgacggctcct<br>tcttcctctacagcaagctcaccgtggacaagagcaggtggcagcaggggaacgtcttctca<br>tgctccgtgatgcatgaggctctgcacaaccactacacgcagaagagcctctccctgtctcc<br>gggtaaa<br>SEQ ID NO: 103<br>----<br>cagtctgccctgactcagcctcgctcagtgtccgcatctcctgggcagtccgtcaccatttc<br>ctgcactggaacccacaatttggtctcttggtgtcaacatcacccaggcagacctcccaaat<br>tattaatttatgacttcaataagagggcttcaggggtccctgatcgcttctctggctccggg<br>tctggcggcacggcctcctgaccattagtggactccaggatgacgatgacgccgaatattt<br>ttgttgggcatatgaagctttcggcggagggaccaagttgaccgtacttcgtcagcccaagg<br>ctgcccctcggtcactctgttccgccctcctctgaggagcttcaagccaacaaggccaca<br>ctggtgtgtctcataagtgacttctacccgggagccgtgacagtggcttggaaagcagatag<br>cagccccgtcaaggcgggagtggagaccaccacacctccaaacaaagcaacaacaagtacg<br>cggccagcagctatctgagcctgacgcctgagcagtggaagtcccacagaagctacagctgc<br>caggtcacgcatgaagggagcaccgtggagaagacagtggcccctacagaatgttca<br>SEQ ID NO: 104 |
| Sequence 15 | N49P73 | gcggacttggtgcagtctggggctgtggtgaagaagcctggggactcagtgagaatctcctg<br>tgaggctcaaggatacagattcactgactacgtcattcattggattcgacgggcccctggac<br>aaggccttgaatggatggggttgatggatccaagttttggacgaatgaatattccacggaaa<br>tttcagggcagggtctccatgacccgggacacgtccatgaaacagcatttctggacttcag<br>aggtctaaattttgacgacacgggcctctattattgcgtgagagatcgaagtcatggatcgg<br>gaagactattcgagtcctccaattggttcctcgatctgtggggccgcggcactgtggtcact<br>gttcagtcaccctccaccaagggcccatcggtcttcccctggcaccctcctccaagagcac<br>ctctgggggcacagcggccctgggctgcctggtcaaggactacttccccgaaccggtgacgg<br>tgtcgtggaactcaggcgccctgaccagcggcgtgcacaccttcccggctgtcctacagtcc<br>tcaggactctactccctcagcagcgtggtgaccgtgccctccagcagcttgggcacccagac<br>ctacatctgcaacgtgaatcacaagcccagcaacaccaaggtggacaagaaagttgagccca<br>aatcttgtgacaaaactcacacatgcccaccgtgcccagcacctgaactcctgggggaccg<br>tcagtcttcctcttccccccaaaacccaaggacaccctcatgatctcccggacccctgaggt<br>cacatgcgtggtggtggacgtgagccacgaagacctgaggtcaagttcaactggtacgtgg<br>acggcgtggaggtgcataatgccaagacaaagccgcggggaggagcagtacaacagcacgtac<br>cgggtggtcagcgtcctcaccgtcctgcaccaggactggctgaatggcaaggagtacaagtg<br>caaggtctccaacaaagcccctcccagcccccatcgagaaaaccatctccaaagccaaagggc<br>agccccgagaaccacaggtgtacaccctgcccccatcccgggatgagctgaccaagaaccag<br>gtcagcctgacctgcctggtcaaaggcttctatcccagcgacatcgccgtggagtgggagag<br>caatgggcagccggagaacaactacaagaccacgcctcccgtgctggactccgacggctcct<br>tcttcctctacagcaagctcaccgtggacaagagcaggtggcagcaggggaacgtcttctca<br>tgctccgtgatgcatgaggctctgcacaaccactacacgcagaagagcctctccctgtctcc<br>gggtaaa<br>SEQ ID NO: 105<br>----<br>cagtctgccctgactcagcctcgctcagtgtccgcatctcctgggcagtccgtcaccatttc<br>ctgcactggaacccacaatttggtctcttggtgtcaacatcacccaggcagacctcccaaat<br>tattaatttatgacttcaataagagggcatcaggggtccctgatcgcttctctggctccggg<br>tctggcggcacggcctcctgaccatcagtggactccaagatgacgatgacgccgaatattt<br>ttgttgggcatatgaagctttcggcggagggaccaagttgaccgtacttcgtcagcccaagg<br>ctgcccctcggtcactctgttccgccctcctctgaggagcttcaagccaacaaggccaca |

TABLE 2-continued

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| | | ctggtgtgtctcataagtgacttctacccgggagccgtgacagtggcttggaaagcagatag cagccccgtcaaggcgggagtggagaccaccacaccctccaaacaaagcaacaacaagtacg cggccagcagctatctgagcctgacgcctgagcagtggaagtcccacagaagctacagctgc caggtcacgcatgaagggagcaccgtggagaagacagtggcccctacagaatgttca<br>SEQ ID NO: 106 |
| Sequence 16 | N49P74 | ccggacttggtgcagtctggggctgtggtgaagaagcctggggactcagtgagaatttcctg tgaggctcaaggatacacattcattgactacgtcattcactggattcgacgggcccctggac aaggccttgaatggatggggttgatggatccaacttatggacgaatgaatattccacggaag tttcagggcagggtctccatgacccgggacacgtccatcgaaacagcattctctggacttaag aggtctaaaatctgacgacacgggcctctattattgcgtgagagatcgaagtcatggatcgg gaaggctattcgagtcctccaactggttcctggatctgtggggccgcggcactgtggtcact gttcagtcaccctccaccaagggcccatcggtcttccccctggcaccctcctccaagagcac ctctgggggcacagcggccctgggctgcctggtcaaggactacttccccgaaccggtgacgg tgtcgtggaactcaggcgccctgaccagcggcgtgcacaccttcccggctgtcctacagtcc tcaggactctactccctcagcagcgtggtgaccgtgccctccagcagcttgggcacccagac<br>ct<br>acatctgcaacgtgaatcacaagcccagcaacaccaaggtggacaagaaagttgagcccaaa tcttgtgacaaaactcacacatgcccaccgtgcccagcacctgaactcctggggggaccgtc agtcttcctcttccccccaaaacccaaggacaccctcatgatctcccggacccctgaggtca catgcgtggtggtggacgtgagccacgaagaccctgaggtcaagttcaactggtacgtggac ggcgtggaggtgcataatgccaagacaaagccgcgggaggagcagtacaacagcacgtaccg ggtggtcagcgtcctcaccgtcctgcaccaggactggctgaatggcaaggagtacaagtgca aggtctccaacaaagccctcccagcccccatcgagaaaaccatctccaaagccaaagggcag ccccgagaaccacaggtgtacaccctgcccccatcccgggatgagctgaccaagaaccaggt cagcctgacctgcctggtcaaaggcttctatcccagcgacatcgccgtggagtgggagagca atgggcagccggagaacaactacaagaccacgcctcccgtgctggactccgacggctccttc ttcctctacagcaagctcaccgtggacaagagcaggtggcagcaggggaacgtcttctcatg ctccgtgatgcatgaggctctgcacaaccactacacgcagaagagcctctccctgtctccgg<br>gtaaa<br>SEQ ID NO: 107 |
| | | cagtctgccctgactcagcctcgctcagtgtccgcatctcctgggcagtccgtcaccatttc ctgcactggaacccacaatttggtctcttggtgtcaacatcacccaggcagacctcccaaat tattaatttatgacttcaataagagggcttcaggggtccctgatcgcttctctggctccggg tctggcggcacggcctccctgaccatcagtggactccaagatgacgatgacgccgaatattt tgttgggcatatgaagctttcggcggagggaccaagttgaccgtacttcgtcagcccaagg ctgccccctcggtcactctgttcccgccctcctctgaggagcttcaagccaacaaggccaca ctggtgtgtctcataagtgacttctacccgggagccgtgacagtggcttggaaagcagatag cagccccgtcaaggcgggagtggagaccaccacaccctccaaacaaagcaacaacaagtacg cggccagcagctatctgagcctgacgcctgagcagtggaagtcccacagaagctacagctgc caggtcacgcatgaagggagcaccgtggagaagacagtggcccctacagaatgttca<br>SEQ ID NO: 108 |
| Sequence 17 | N49P75 | gcggacttggtgcagtctggggctgtggtgaagaagcctggggactcagtgaggatctcctg tgaggctcaaggatacagatttcttgactacatcattcactggattcgacgggcccctggac aaggccttgaatggatgggatggatgaatccaatgggcggacaagtaaacattccatggaac tttcagggtagggtctccatgacccgggacacgtccatcgaaacagcatttctggacttaag aggactaaagtctgacgacacggccgtctattattgcgtgagagatcgcagtaatggatcgg gaaagcgattcgagtcctccaattggttcctcgatctgtggggccgcgggactgcggtcact attcattcaccctccaccaagggcccatcggtcttccccctggcaccctcctccaagagcac ctctgggggcacagcggccctgggctgcctggtcaaggactacttccccgaaccggtgacgg tgtcgtggaactcaggcgccctgaccagcggcgtgcacaccttcccggctgtcctacagtcc tcaggactctactccctcagcagcgtggtgaccgtgccctccagcagcttgggcacccagac ctacatctgcaacgtgaatcacaagcccagcaacaccaaggtggacaagaaagttgagccca aatcttgtgacaaaactcacacatgcccaccgtgcccagcacctgaactcctgggggaccgt cagtcttcctcttccccccaaaacccaaggacaccctcatgatctcccggacccctgaggt cacatgcgtggtggtggacgtgagccacgaagaccctgaggtcaagttcaactggtacgtgg acggcgtggaggtgcataatgccaagacaaagccgcgggaggagcagtacaacagcacgtac cgggtggtcagcgtcctcaccgtcctgcaccaggactggctgaatggcaaggagtacaagtg caaggtctccaacaaagccctcccagcccccatcgagaaaaccatctccaaagccaaagggc agccccgagaaccacaggtgtacaccctgcccccatcccgggatgagctgaccaagaaccag gtcagcctgacctgcctggtcaaaggcttctatcccagcgacatcgccgtggagtgggagag caatgggcagccggagaacaactacaagaccacgcctcccgtgctggactccgacggctcct tcttcctctacagcaagctcaccgtggacaagagcaggtggcagcaggggaacgtcttctca tgctccgtgatgcatgaggctctgcacaaccactacacgcagaagagcctctccctgtctcc<br>gggtaaa<br>SEQ ID NO: 109 |

TABLE 2-continued

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| | | cagtctgccctgactcagcctcgctcagtgtccgcatctcctgggcagtccgtcaccatttc<br>ctgcactggaacccacaatttggtctcttggtgtcaacatcacccaggcagagcccccaaat<br>tattaatttatgacttcaataagaggccctcaggggtccctgatcgcttctctggctccggg<br>tctggcggcacggcctccctgaccatcactggactccaggatgacgatgacgccgaatattt<br>ttgttgggcgtatgaagcttttggcggagggaccaagttgaccgtacttcgtcagcccaagg<br>ctgcccctcggtcactctgttcccgccctcctctgaggagcttcaagccaacaaggccaca<br>ctggtgtgtctcataagtgacttctacccgggagccgtgacagtggcttggaaagcagatag<br>cagcccgtcaaggcgggagtggagaccaccacaccctccaaacaaagcaacaacaagtacg<br>cggccagcagctatctgagcctgacgcctgagcagtggaagtcccacagaagctacagctgc<br>caggtcacgcatgaagggagcaccgtggagaagacagtggcccctacagaatgttca<br>SEQ ID NO: 110 |
| Sequence 18 | N49P9<br>N49P9.1<br>N49P9.2<br>N49P9i7 | cacgtccaattggtgcagtctggaggtggggtgaagaagattggggccgctgtgaggatctc<br>ctgcgaggtgactggatataaattcatggaccaactcataaactgggtgcggcaggcccccg<br>gtcagggccttgagtggatgggatggatgaatccaacatatggacaagtaaattattcatgg<br>agatttgaaggaagggtcaccatgaccagggacatggacaccgagacggccttcatggagtt<br>gagaggactgagagtggacgacacggccgtctattattgcgcgagggggccctctggggaaa<br>attatccttttcactattggggccagggtgtccgagtggtcgtctgcaccctccaccaag<br>ggcccatcggtcttccccctggcaccctcctccaagagcacctctggggggcacagcggcct<br>gggctgcctggtcaaggactacttccccgaaccggtgacggtgtcgtggaactcaggcgccc<br>tgaccagcggcgtgcacaccttcccggctgtcctacagtcctcaggactctactccctcagc<br>agcgtggtgaccgtgccctccagcagcttgggcacccagacctacatctgcaacgtgaatca<br>caagcccagcaacaccaaggtggacaagaaagttgagcccaaatcttgtgacaaaactcaca<br>catgcccaccgtgcccagcacctgaactcctgggggaccgtcagtcttcctcttccccca<br>aaacccaaggacaccctcatgatctcccggacccctgaggtcacatgcgtggtggtggacgt<br>gagccacgaagaccctgaggtcaagttcaactggtacgtggacggcgtggaggtgcataatg<br>ccaagacaaagccgcggggaggagcagtacaacagcacgtaccgggtggtcagcgtcctcacc<br>gtcctgcaccaggactggctgaatggcaaggagtacaagtgcaaggtctccaacaaagccct<br>cccagcccccatcgagaaaaccatctccaaagccaaagggcagccccgagaaccacaggtgt<br>acaccctgcccccatcccgggatgagctgaccaagaaccaggtcagcctgacctgcctggtc<br>aaaggcttctatcccagcgacatcgccgtggagtgggagagcaatgggcagccggagaacaa<br>ctacaagaccacgcctcccgtgctggactccgacggctccttcttcctctacagcaagctca<br>ccgtggacaagagcaggtggcagcaggggaacgtcttctcatgctccgtgatgcatgaggct<br>ctgcacaaccactacacgcagaagagcctctccctgtctccgggtaaa<br>SEQ ID NO: 111 |
| | | gcatctgccctgactcagcctgcctccatgtctgcgtccctggacagtcggtaaccatctc<br>gtgctctggaaccagacacataatctctgcttggttccaacaatatccaggcaaaccaccca<br>aactcataattttttgacgacgataagcgtccctctggagttcgtactgcttctctgcctcc<br>aggcctggcgacacggcctccctgacaatctctaatgttcaacctgaggacgaggcgacgta<br>catttgcaatacatatgaattctttggcggagggaccagattgaccgtcctaagtcagccca<br>aggctgcccctcggtcactctgttcccaccctcctctgaggagcttcaagccaacaaggcc<br>acactggtgtgtctcgtaagtgacttctacccgggagccgtgacagtggcctggaaggcaga<br>tggcagccccgtcaaggtgggagtggagaccaccaaacccctccaaacaaagcaacaacaagt<br>atgcggccagcagctacctgagcctgacgcccgagcagtggaagtcccacagaagctacagc<br>tgccgggtcacgcatgaagggagcaccgtggagaagacagtggcccctgcagaatgctct<br>SEQ ID NO: 112 |
| Sequence 19 | N49P22 | cacattcagttgctacagtcggggcctcaagttaagaagtctggggacacagtgagaatctc<br>ctgtgagacctctggatataacttcgtcgactcccgtatccactgggtccgacagacccgg<br>aaaaacgtctcagatggatgggctggatcaatcctctccaaggtggtgtgaattacgcgccg<br>gaatttcagggcagaatcaggatgaccagggacacattatagacacagtttacgtggacct<br>gagcggactgacaccggccgacacggcctattattactgcgcgcgagggatcgatggcaagt<br>cttaccccttcatttctggggccacggaacccgggtcaccgtcttctcggcctccaccaag<br>ggcccatcggtcttccccctggcaccctcctccaagagcacctctggggggcacagcggcct<br>gggctgcctggtcaaggactacttccccgaaccggtgacggtgtcgtggaactcaggcgccc<br>tgaccagcggcgtgcacaccttcccggctgtcctacagtcctcaggactctactccctcagc<br>agcgtggtgaccgtgccctccagcagcttgggcacccagacctacatctgcaacgtgaatca<br>caagcccagcaacaccaaggtggacaagaaagttgagcccaaatcttgtgacaaaactcaca<br>catgcccaccgtgcccagcacctgaactcctgggggaccgtcagtcttcctcttccccca<br>aaacccaaggacaccctcatgatctcccggacccctgaggtcacatgcgtggtggtggacgt<br>gagccacgaagaccctgaggtcaagttcaactggtacgtggacggcgtggaggtgcataatg<br>ccaagacaaagccgcggggaggagcagtacaacagcacgtaccgggtggtcagcgtcctcacc<br>gtcctgcaccaggactggctgaatggcaaggagtacaagtgcaaggtctccaacaaagccct<br>cccagcccccatcgagaaaaccatctccaaagccaaagggcagccccgagaaccacaggtgt<br>acaccctgcccccatcccgggatgagctgaccaagaaccaggtcagcctgacctgcctggtc<br>aaaggcttctatcccagcgacatcgccgtggagtgggagagcaatgggcagccggagaacaa<br>ctacaagaccacgcctcccgtgctggactccgacggctccttcttcctctacagcaagctca<br>ccgtggacaagagcaggtggcagcaggggaacgtcttctcatgctccgtgatgcatgaggct |

TABLE 2-continued

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| | | ctgcacaaccactacacgcagaagagcctctccctgtctccgggtaaa<br>SEQ ID NO: 113 |
| | | ------------------------------------------------------------------<br>cgatttgccctgactcaacctgcctccgtgtctgggtctcctggacagacgatcaccataac<br>ctgcgctggaggcagcgtctcctggtttcatttccctccaggcaaaaccccagactcatta<br>tttatgagtcttctaagcgaccctctggggtctctcctcgattctctgggtcccagtctggc<br>agcacggcctcccttataatttctggcctccagtctgatgacgaagggacatacttctgttc<br>tattcttgaattttcggcagagggactcttgtcaccgtcctgagtcagcccaaggctgccc<br>cctcggtcactctgttcccaccctcctctgaggagcttcaagccaacaaggccacactggtg<br>tgtctcgtaagtgacttctacccggggagccgtgacagtggcctggaaggcagatggcagccc<br>cgtcaaggtgggagtggagaccaccaaaccctccaaacaaagcaacaacaagtatgcggcca<br>gcagctacctgagcctgacgcccgagcagtggaagtcccacagaagctacagctgccgggtc<br>acgcatgaagggagcaccgtggagaagacagtggcccctgcagaatgctct<br>SEQ ID NO: 114 |
| Sequence 20 | N49P23 | caggtgcgcttggtgcagtctggggctggggcgaggaagactggggcctcaatgaaactttc<br>ctgctcgacctctggatacaccttcaccactcatcacggccacttcataaattgggtgcgac<br>aggcccgtggacaagggcttgagtggatgggtggatgaatcccatgactgggcagatgaat<br>attgaggggaaattcagggcagagtcaccctcactcgagacatatacagtgacacggctta<br>catggaaatgaccagactgacaactggcgacacgggcacttattactgtgcgcgaggcgatt<br>tcggacagaattatccctttcattattggggccagggaagcctggtcatcgtctcctcggcc<br>tccaccaagggcccatcggtcttccccctggcaccctcctccaagagcacctctgggggcac<br>agcggccctgggctgcctggtcaaggactacttccccgaaccggtgacggtgtcgtggaact<br>caggcgccctgaccagcggcgtgcacaccttcccggctgtcctacagtcctcaggactctac<br>tccctcagcagcgtggtgaccgtgccctccagcagcttgggcacccagacctacatctgcaa<br>cgtgaatcacaagcccagcaacaccaaggtggacaagaaagttgagcccaaatcttgtgaca<br>aaactcacacatgcccaccgtgcccagcacctgaactcctgggggaccgtcagtcttcctc<br>ttcccccccaaaacccaaggacaccctcatgatctcccggacccctgaggtcacatgcgtggt<br>ggtggacgtgagccacgaagaccctgaggtcaagttcaactggtacgtggacggcgtggagg<br>tgcataatgccaagacaaagccgcgggaggagcagtacaacagcacgtaccgggtggtcagc<br>gtcctcaccgtcctgcaccaggactggctgaatggcaaggagtacaagtgcaaggtctccaa<br>caaagcctcccagcccccatcgagaaaaccatctccaaagccaaagggcagccccgagaac<br>cacaggtgtacaccctgcccccatcccgggatgagctgaccaagaaccaggtcagcctgacc<br>tgcctggtcaaaggcttctatcccagcgacatcgccgtggagtgggagagcaatgggcagcc<br>ggagaacaactacaagaccacgcctcccgtgctggactccgacggctccttcttcctctaca<br>gcaagctcaccgtggacaagagcaggtggcagcaggggaacgtcttctcatgctccgtgatg<br>catgaggctctgcacaaccactacacgcagaagagcctctccctgtctccgggtaaa<br>SEQ ID NO: 115 |
| | | ------------------------------------------------------------------<br>ctgtctgccctgactcagcctgcctccgtgtctgggtctcctgggcagtcggtcaccatctc<br>ctgctctggaacgaaccgttaccttgtctcctggtatcaacaacaccctgacaaagcccca<br>aactcatcatttatgacgacaataagcggccctcaggaatttctgatcgcttctcagcctcc<br>aggcctgacgacacggcctccctgacaatctctggactccagactggggacgaggctactta<br>ttggtgtgcctcatatgaacgttttggcggcgggacgaggctgaccgtcttagtcagccca<br>aggctgcccctcggtcactctgttcccaccctcctctgaggagcttcaagccaacaaggcc<br>acactggtgtgtctcgtaagtgacttctacccgggagccgtgacagtggcctggaaggcaga<br>tggcagccccgtcaaggtgggagtggagaccaccaaaccctccaaacaaagcaacaacaagt<br>atgcggccagcagctacctgagcctgacgcccgagcagtggaagtcccacagaagctacagc<br>tgccgggtcacgcatgaagggagcaccgtggagaagacagtggcccctgcagaatgctct<br>SEQ ID NO: 116 |
| Sequence 21 | N49P9.3<br>N49P9.4 | cacgtccaattggtgcagtctggaggtggggtgaagaagattggggccgctgtgaggatctc<br>ctgcgaggtgtctggatacaacttcatggaccaattcataaattgggtgcgacaggccccg<br>gtcagggccttgagtggatgggatggatgaacccaatatatggacaagtaaattattcatgg<br>agatttcaaggaagggtcaccatgaccaggacatgtacaccgacacggccttcatggagtt<br>gagaggactgagagtgacgacacggccgtctattattgcgcgagggggccctctgggggaaa<br>attatccttttcactattggggccagggtgtccgagtggtcgtctcgtcaccctccaccaag<br>ggcccatcggtcttccccctggcaccctcctccaagagcacctctgggggcacagcggccct<br>gggctgcctggtcaaggactacttccccgaaccggtgacggtgtcgtggaactcaggcgccc<br>tgaccagcggcgtgcacaccttcccggctgtcctacagtcctcaggactctactccctcagc<br>agcgtggtgaccgtgccctccagcagcttgggcacccagacctacatctgcaacgtgaatca<br>caagcccagcaacaccaaggtggacaagaaagttgagcccaaatcttgtgacaaaactcaca<br>catgcccaccgtgcccagcacctgaactcctgggggaccgtcagtcttcctcttccccca<br>aaacccaaggacaccctcatgatctcccggacccctgaggtcacatgcgtggtggtggacgt<br>gagccacgaagaccctgaggtcaagttcaactggtacgtggacggcgtggaggtgcataatg<br>ccaagacaaagccgcgggaggagcagtacaacagcacgtaccgggtggtcagcgtcctcacc<br>gtcctgcaccaggactggctgaatggcaaggagtacaagtgcaaggtctccaacaaagccct<br>cccagcccccatcgagaaaaccatctccaaagccaaagggcagccccgagaaccacaggtgt<br>acaccctgcccccatcccgggatgagctgaccaagaaccaggtcagcctgacctgcctggtc |

TABLE 2-continued

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| | | aaaggcttctatcccagcgacatcgccgtggagtgggagagcaatgggcagccggagaacaa<br>ctacaagaccacgcctcccgtgctggactccgacggctccttcttcctctacagcaagctca<br>ccgtggacaagagcaggtggcagcaggggaacgtcttctcatgctccgtgatgcatgaggct<br>ctgcacaaccactacacgcagaagagcctctccctgtctccgggtaaa<br>SEQ ID NO: 117 |
| | | gcatctgccctgactcagcctgcctccatgtctgcgtcccctggacagtcggtaaccatctc<br>gtgctctggaaccagacacataatctctgcttggttccaacaatatccaggcaaaccaccca<br>aactcataattttttgacgacgataagcgtccctctggagttcctagtcgcttctctgcctcc<br>aggcctggcgacacggcctccctgacaatctctaatgttcaacctgaggacgaggcgacata<br>catttgcaatacatatgaattctttggcggagggaccaaattgaccgtcctaagtcagccca<br>aggctgcccctcggtcactctgttcccaccctcctctgaggagcttcaagccaacaaggcc<br>acactggtgtgtctcgtaagtgacttctacccgggagccgtgacagtggcctggaaggcaga<br>tggcagcccccgtcaaggtgggagtggagaccaccaaaccctccaaacaaagcaacaacaagt<br>atgcggccagcagctacctgagcctgacgcccgagcagtggaagtcccacagaagctacagc<br>tgccgggtcacgcatgaagggagcaccgtggagaagacagtggcccctgcagaatgctct<br>SEQ ID NO: 118 |
| Sequence 22 | N49P51 | cacattcagttgctacagtcggggcctcaagttaagaagtctggggacacagtgagaatctc<br>ctgtgagacctctggatataacttcgtcgactcccgtatccactgggtccgacagacccgg<br>aaaaacgtctcagatggatgggctggatcaatcctctccacggtggtgtgaattacgcgccg<br>gaatttcagggcagaatcaggatgaccaggacacatttatagacacagtttacgtggacct<br>gagcggactgacaccggccgacacggcctattattactgcgcgcgagggatcgatggcaagt<br>cttacccctttcatttctggggccacggaacccgggtcaccgtcttctcggcctccaccaag<br>ggcccatcggtcttccccctggcaccctcctccaagagcacctctgggggcacagcggccct<br>gggctgcctggtcaaggactacttccccgaaccggtgacggtgtcgtggaactcaggcgccc<br>tgaccagcggcgtgcacaccttcccggctgtcctacagtcctcaggactctactccctcagc<br>agcgtggtgaccgtgccctccagcagcttgggcacccagacctacatctgcaacgtgaatca<br>caagcccagcaacaccaaggtggacaagaaagttgagcccaaatcttgtgacaaaactcaca<br>catgcccaccgtgcccagcacctgaactcctgggggaccgtcagtcttcctcttcccccca<br>aaacccaaggacaccctcatgatctcccggacccctgaggtcacatgcgtggtggtggacgt<br>gagccacgaagaccctgaggtcaagttcaactggtacgtggacggcgtggaggtgcataatg<br>ccaagacaaagccgcgggaggagcagtacaacagcacgtaccgggtggtcagcgtcctcacc<br>gtcctgcaccaggactggctgaatggcaaggagtacaagtgcaaggtctccaacaaagccct<br>cccagccccatcgagaaaaccatctctcaaagccaaagggcagccccgagaaccacaggtgt<br>acaccctgcccccatcccgggatgagctgaccaagaaccaggtcagcctgacctgcctggtc<br>aaaggcttctatcccagcgacatcgccgtggagtgggagagcaatgggcagccggagaacaa<br>ctacaagaccacgcctcccgtgctggactccgacggctccttcttcctctacagcaagctca<br>ccgtggacaagagcaggtggcagcaggggaacgtcttctcatgctccgtgatgcatgaggct<br>ctgcacaaccactacacgcagaagagcctctccctgtctccgggtaaa<br>SEQ ID NO: 119 |
| | | cgatttgccctgactcaacctgcctccgtgtctgggtctccctggacagacgatcaccataac<br>ctgcgctggaggcagcgtctcctggtttcatttccctccaggcaaaaccccccagactcatta<br>tttatgagtcttctaagcgaccctctggggtctctcctcgattctctgggtcccagtctggc<br>agcacggcctccctcataatttctggcctccagtctgatgacgaagggacatactttctgttc<br>tattcttgaattttcggcagagggactcttgtcaccgtcctgagtcagcccaaggctgccc<br>cctcggtcactctgttcccaccctcctctgaggagcttcaagccaacaaggccacactggtg<br>tgtctcgtaagtgacttctacccgggagccgtgacagtggccggaaggcagatggcagccc<br>cgtcaaggtgggagtggagaccaccaaaccctccaaacaaagcaacaacaagtatgcggcca<br>gcagctacctgagcctgacgcccgagcagtggaagtcccacagaagctacagctgccgggtc<br>acgcatgaagggagcaccgtggagaagacagtggcccctgcagaatgctct<br>SEQ ID NO: 120 |
| Sequence 23 | N49P52 | cgtgttacattacaacaatctggggctatagtgaggcagcctggggcctcagtgaccgtctc<br>ctgcgagacttctggatatactttcaccaagtatttcatctactgggtgcgacaggcccctg<br>gacagggtcttgagtggctgggcagaatacaccccccgaaccggtgccgtgaagtatgcaccg<br>agatttcagggtagactgtccatgaccagagactggtcactcgacacagcctacctcggatt<br>gaccggactgacactcggcgacacggctctatatttctgtgcgaggggggccttttgaggcag<br>attcatatggtcaagttatcccttcaccactggggccagggaaccctagtcaccgtctcc<br>gcggcctccaccaagggcccatcggtcttccccctggcaccctcctccaagagcacctctgg<br>gggcacagcggccctgggctgcctggtcaaggactacttccccgaaccggtgacggtgtcgt<br>ggaactcaggcgccctgaccagcggcgtgcacaccttcccggctgtcctacagtcctcagga<br>ctctactccctcagcagcgtggtgaccgtgccctccagcagcttgggcacccagacctacat<br>ctgcaacgtgaatcacaagcccagcaacaccaaggtggacaagaaagttgagcccaaatctt<br>gtgacaaaactcacacatgcccaccgtgcccagcacctgaactcctgggggaccgtcagtc<br>ttcctcttccccccaaaacccaaggacaccctcatgatctcccggacccctgaggtcacatg<br>cgtggtggtggacgtgagccacgaagaccctgaggtcaagttcaactggtacgtggacggcg<br>tggaggtgcataatgccaagacaaagccgcgggaggagcagtacaacagcacgtaccgggtg |

TABLE 2-continued

Amino acid sequence of natural antibodies. Heavy chain is shown first
(above dotted line), followed by the light chain (below dotted line).
Sequences of CDRH1, CDRH2, CDRH3, CDRL1, CDRL2, and CDRL3 are in
bold. Note that there is a predicted 5 blank CDR in the light chain
for Sequences 25, 34 and 36.

| Natural antibody | Related variants | Nucleotide sequence |
|---|---|---|
| | | gtcagcgtcctcaccgtcctgcaccaggactggctgaatggcaaggagtacaagtgcaaggt<br>ctccaacaaagccctcccagccccatcgagaaaaccatctccaaagccaaagggcagcccc<br>gagaaccacaggtgtacaccctgcccccatcccgggatgagctgaccaagaaccaggtcagc<br>ctgacctgcctggtcaaaggcttctatcccagcgacatcgccgtggagtgggagagcaatgg<br>gcagccggagaacaactacaagaccacgcctcccgtgctggactccgacggctccttcttcc<br>tctacagcaagctcaccgtggacaagagcaggtggcagcaggggaacgtcttctcatgctcc<br>gtgatgcatgaggctctgcacaaccactacacgcagaagagcctctccctgtctccgggtaa<br>a<br>SEQ ID NO: 121 |
| | | tcctgggccctgactcaacccgcctccgtgtctgcgtctcctgggcagtcggtcaccatgtc<br>ctgcactggattcggaaattataaccctgactcctggtaccaacaatacccaggcaaagccc<br>ccaaactcatcatttatgaagacaataaaagaccctcgggggtctctgatcgcttctctgcc<br>tccagacttggcagcacgtcttccctgacaatctctaacgtccaggctgcggacgacgccca<br>ttatgtctgcgcctcctttgaattttcggcggagggaccaagctgaccgtcctgagtcagc<br>ccaaggctgcccctcggtcactctgttccaccctcctctgaggagcttcaagccaacaag<br>gccacactggtgtgtctcgtaagtgacttctacccgggagccgtgacagtggcctggaaggc<br>agatggcagcccgtcaaggtgggagtggagaccaccaaaccctccaaacaaagcaacaaca<br>gtatgcggccagcagctacctgagcctgacgcccgagcagtggaagtcccacagaagctac<br>agctgccgggtcacgcatgaaggggagcaccgtggagaagacagtggcccctgcagaatgctc<br>t<br>SEQ ID NO: 122 |
| Sequence 24 | N49P53 | cgtgtgacattacaacaatctggggctacagtgaagcagcctggggcctcagtgaccgtctc<br>ctgcgagacttctggatacactttcaccaagtataccattcactgggtgcgacaggcccctg<br>gacagggtcttcagtgggtgggcagaatacaccccgaaccggtgccgtgaagtatgcaccg<br>atatttcagggtaaagtgtccatgagtcgagacttgtcacgcgacacagcctacctcggatt<br>gaccagactgacgctcgccgacacggctctattttctgtgcgagggggccttgaggcag<br>atttaagtgggccaacttaccccttcaccactgggccaaggaaccctagtcatcgtctcg<br>cggcctccaccaagggcccatcggtcttcccctggcaccctcctccaagagcacctcctgg<br>gggcacagcgggcctgggctgcctggtcaaggactacttccccgaaccggtgacggtgtcgt<br>ggaactcaggcgccctgaccagcggcgtgcacaccttcccggctgtcctacagtcctcagga<br>ctctactccctcagcagcgtggtgaccgtgccctccagcagcttgggcacccagacctacat<br>ctgcaacgtgaatcacaagcccagcaacaccaaggtggacaagaaagttgagcccaaatctt<br>gtgacaaaactcacacatgcccaccgtgcccagcacctgaactcctggggggaccgtcagtc<br>ttcctcttccccccaaaacccaaggacacccttcatgatctccggaccctgaggtcacatg<br>cgtggtggtggacgtgagccacgaagaccctgaggtcaagttcaactggtacgtggacggcg<br>tggaggtgcataatgccaagacaaagccgcgggaggagcagtacaacagcacgtaccgggtg<br>gtcagcgtcctcaccgtcctgcaccaggactggctgaatggcaaggagtacaagtgcaaggt<br>ctccaacaaagccctcccagccccatcgagaaaaccatctccaaagccaaagggcagcccc<br>gagaaccacaggtgtacaccctgcccccatcccgggatgagctgaccaagaaccaggtcagc<br>ctgacctgcctggtcaaaggcttctatcccagcgacatcgccgtggagtgggagagcaatgg<br>gcagccggagaacaactacaagaccacgcctcccgtgctggactccgacggctccttcttcc<br>tctacagcaagctcaccgtggacaagagcaggtggcagcaggggaacgtcttctcatgctcc<br>gtgatgcatgaggctctgcacaaccactacacgcagaagagcctctccctgtctccgggtaa<br>a<br>SEQ ID NO: 123 |
| | | tcctgggccctgactcaacccgcctccgtgtctgcgtctcctgggcagtcggtcaccatgtc<br>ctgcactggattcggaaattataaccctgactcctggtaccaacaatacccaggcaaagccc<br>ccaaactcatcatttatgaggacaataaaagaccctcggagtctctaatcgcttctctgcc<br>tccagacttggcagcacgtcttccctgacaatctctaacgtccaggctgcggacgacgccca<br>ttatgtctgcgcctcctttgaattttcggcggagggaccaagctgatcgtcctgagtcagc<br>ccaaggctgcccctcggtcactctgttccaccctcctctgaggagcttcaagccaacaag<br>gccacactggtgtgtctcgtaagtgacttctacccgggagccgtgacagtggcctggaaggc<br>agatggcagcccgtcaaggtgggagtggagaccaccaaaccctccaaacaaagcaacaaca<br>gtatgcggccagcagctacctgagcctgacgcccgagcagtggaagtcccacagaagctac<br>agctgccgggtcacgcatgaaggggagcaccgtggagaagacagtggcccctgcagaatgctc<br>t<br>SEQ ID NO: 124 |
| Sequence 25 | N49P54 | aacgtgcagttgatgcagtctgggactgaggtgaagaagtctggggcctcggtgacaatctc<br>ttgtgagaccgctggattcaacttcatcgactccgtcatacactggctgcgccaggcccctg<br>gaggagatttcagtggatgggtggattcaagcctcttagaggtgccgtcaattatccacag<br>tttttgcagggcagggtctccatgacccgggacttgtccaccgacacggtgtacatggtctt<br>gaatggactgacacctgacgacacaggcctttattactgcgcgaaaggggcctttagaggg<br>gttctcccttggcttctgggcagggaactctgctcaccgtctccccagcctccaccaag<br>ggcccatcggtcttcccctggcaccctcctccaagagcacctctggggcacagcggccct<br>gggctgcctggtcaaggactacttccccgaaccggtgacggtgtcgtggaactcaggcgccc |

TABLE 2-continued

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| | | tgaccagcggcgtgcacaccttcccggctgtcctacagtcctcaggactctactccctcagc<br>agcgtggtgaccgtgccctccagcagcttgggcacccagacctacatctgcaacgtgaatca<br>caagcccagcaacaccaaggtggacaagaaagttgagcccaaatcttgtgacaaaactcaca<br>catgcccaccgtgcccagcacctgaactcctgggggggaccgtcagtcttcctcttccccccca<br>aaacccaaggacaccctcatgatctcccggacccctgaggtcacatgcgtggtggtggacgt<br>gagccacgaagaccctgaggtcaagttcaactggtacgtggacggcgtggaggtgcataatg<br>ccaagacaaagccgcgggaggagcagtacaacagcacgtaccgggtggtcagcgtcctcacc<br>gtcctgcaccaggactggctgaatggcaaggagtacaagtgcaaggtctccaacaaagccct<br>cccagcccccatcgagaaaaccatctccaaagccaaagggcagccccgagaaccacaggtgt<br>acaccctgcccccatcccgggatgagctgaccaagaaccaggtcagcctgacctgcctggtc<br>aaaggcttctatcccagcgacatcgccgtggagtgggagagcaatgggcagccggagaacaa<br>ctacaagaccacgcctcccgtgctggactccgacggctccttcttcctctacagcaagctca<br>ccgtggacaagagcaggtggcagcaggggaacgtcttctcatgctccgtgatgcatgaggct<br>ctgcacaaccactacacgcagaagagcctctccctgtctccgggtaaa<br>SEQ ID NO: 125 |
| | | cagtctgccctgtctcagcctgtctccgtgtctgggtctcctggagagtcgatcaccatttc<br>ctgtactggagccaccacctggtatcaacaactcccaggcagaccccccaaactcatcattt<br>atgacgtcactaaccggccctcaggcatttctagtcgtttctctggctccacgtctggccac<br>acggcctccctgacaatctccggtctccaggttgacgacgagggtctgtatcactgcgcctc<br>acgtgaattttcggcggagggaccaagctgaccgtcctgagtcagcccaaggctgcccct<br>cggtcactctgttcccaccctcctctgaggagcttcaagccaacaaggccacactggtgtgt<br>ctcgtaagtgacttctacccgggagccgtgacagtggcctggaaggcagatggcagccccgt<br>caaggtgggagtggagaccaccaaaccctccaaacaaagcaacaacaagtatgcggccagca<br>gctacctgagcctgacgcccgagcagtggaagtcccacagaagctacagctgccgggtcacg<br>catgaagggagcaccgtggagaagacagtggcccctgcagaatgctct<br>SEQ ID NO: 126 |
| Sequence 26 | N49P60 | caggtgcgactggtgcagtctgggcctcaggtgaagaagactggggcctcagtgagggtctc<br>ctgcgaaacctctggatacacgttcacctcctacttcatccattggttacgactgggcccg<br>gagagggggcttcagtggatgggttggatcaacccttacatggtgccgtgaattatgaaaac<br>aaatttaggggcagggtcacaatcaccagggacacgtccacagacacagtgtatttggacat<br>gagcagactgaccccctgacgacacggccgtctatttctgcacaagaggaatcgttgctgatg<br>ggtggccctatggccactggggccagggaacccaagtcaccgtctccccggcctccaccaag<br>ggcccatcggtcttccccctggcaccctcctccaagagcacctctgggggcacagcggccct<br>gggctgcctggtcaaggactacttccccgaaccggtgacggtgtcgtggaactcaggcgccc<br>tgaccagcggcgtgcacaccttcccggctgtcctacagtcctcaggactctactccctcagc<br>agcgtggtgaccgtgccctccagcagcttgggcacccagacctacatctgcaacgtgaatca<br>caagcccagcaacaccaaggtggacaagaaagttgagcccaaatcttgtgacaaaactcaca<br>catgcccaccgtgcccagcacctgaactcctgggggggaccgtcagtcttcctcttccccccca<br>aaacccaaggacaccctcatgatctcccggacccctgaggtcacatgcgtggtggtggacgt<br>gagccacgaagaccctgaggtcaagttcaactggtacgtggacggcgtggaggtgcataatg<br>ccaagacaaagccgcgggaggagcagtacaacagcacgtaccgggtggtcagcgtcctcacc<br>gtcctgcaccaggactggctgaatggcaaggagtacaagtgcaaggtctccaacaaagccct<br>cccagcccccatcgagaaaaccatctccaaagccaaagggcagccccgagaaccacaggtgt<br>acaccctgcccccatcccgggatgagctgaccaagaaccaggtcagcctgacctgcctggtc<br>aaaggcttctatcccagcgacatcgccgtggagtgggagagcaatgggcagccggagaacaa<br>ctacaagaccacgcctcccgtgctggactccgacggctccttcttcctctacagcaagctca<br>ccgtggacaagagcaggtggcagcaggggaacgtcttctcatgctccgtgatgcatgaggct<br>ctgcacaaccactacacgcagaagagcctctccctgtctccgggtaaa<br>SEQ ID NO: 127 |
| | | tcctgggccctgactcagcctgcctccgtgtctgggtctcctggacagtcggtcgccatctc<br>ctgcgctggcggcagcgtctcctggtaccaggtgctcccaggcagagcccccaaactcatca<br>tttatgagggcgctaagcgaccctcaggggtttctgctcgcttctctggctcccagtctggc<br>aacacggcttacctgacaatttctgacctccagactgaggacgagggcatctacttctgctc<br>ttcacttcaattcttcggcggagggaccaaactgaccgtcctaagtcagcccaaggctgccc<br>cctcggtcactctgttcccaccctcctctgaggagcttcaagccaacaaggccacactggtg<br>tgtctcgtaagtgacttctacccgggagccgtgacagtggcctggaaggcagatggcagccc<br>cgtcaaggtgggagtggagaccaccaaaccctccaaacaaagcaacaacaagtatgcggcca<br>gcagctacctgagcctgacgcccgagcagtggaagtcccacagaagctacagctgccgggtc<br>acgcatgaagggagcaccgtggagaagacagtggcccctgcagaatgctct<br>SEQ ID NO: 128 |
| Sequence 27 | N49P61 | caggtgcgacttcagcagtctggtgtcgtggtgaggaagcctggggcctcagtgagaatttc<br>ctgcgagacttctggattcaccttcatcgaccacattgtccattgggtgcggcgggcccctg<br>gacgaggctttgaatggatgggttggatcaagcctcttaggggtgccgtagattatgcaccc<br>caacttcggggcaggatctccctgacgagggacatttacagtgaaaccgtctttatagacgt<br>gagtcgactgacgtctggcgacacggcgatatacttttgttgtaaggccgccgcccctgaag |

TABLE 2-continued

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| | | aagcattcccccttcaatactggggccaggggacccaacttatcgtctcctcggcctccacc<br>aagggcccatcggtcttcccctggcaccctcctccaagagcacctctgggggcacagcggc<br>cctgggctgcctggtcaaggactacttccccgaaccggtgacggtgtcgtggaactcaggcg<br>ccctgaccagcggcgtgcacaccttcccggctgtcctacagtcctcaggactctactccctc<br>agcagcgtggtgaccgtgccctccagcagcttgggcacccagacctacatctgcaacgtgaa<br>tcacaagcccagcaacaccaaggtggacaagaaagttgagcccaaatcttgtgacaaaactc<br>acacatgcccaccgtgcccagcacctgaactcctggggggaccgtcagtcttcctcttcccc<br>ccaaaacccaaggacaccctcatgatctcccggacccctgaggtcacatgcgtggtggtgga<br>cgtgagccacgaagaccctgaggtcaagttcaactggtacgtggacggcgtggaggtgcata<br>atgccaagacaaagccgcgggaggagcagtacaacagcacgtaccgggtggtcagcgtcctc<br>accgtcctgcaccaggactggctgaatggcaaggagtacaagtgcaaggtctccaacaaagc<br>cctcccagcccccatcgagaaaaccatctccaaagccaaagggcagccccgagaaccacagg<br>tgtacaccctgcccccatcccgggatgagctgaccaagaaccaggtcagcctgacctgcctg<br>gtcaaaggcttctatcccagcgacatcgccgtggagtgggagagcaatgggcagccggagaa<br>caactacaagaccacgcctcccgtgctggactccgacggctccttcttcctctacagcaagc<br>tcaccgtggacaagagcaggtggcagcaggggaacgtcttctcatgctccgtgatgcatgag<br>gctctgcacaaccactacacgcagaagagcctctccctgtctccgggtaaa<br>SEQ ID NO: 129 |
| | | caggctgccctgactcagcccgcctccgtgtccggctctcctggacagtcggtcaccatttc<br>ctgcctttatgccaatgtagatatctgctggtatcaactacacccgggcagagcccccaaac<br>ttctaattgttgacaataataagcggccctcaggagtctctcctcgcttctctggctccaag<br>tctggcaccacggcctccctgacaatctctggacttcaggctgacgacgaggctgaatatca<br>ctgctcttcaagaacatttttttggcgggggaccaagttgaccgtcctgagtcagcccaagg<br>ctgcccctcggtcactctgttcccaccctcctctgaggagcttcaagccaacaaggccaca<br>ctggtgtgtctcgtaagtgacttctacccgggagccgtgacagtggcctggaaggcagatgg<br>cagccccgtcaaggtgggagtggagaccaccaaaccctccaaacaaagcaacaacaagtatg<br>cggccagcagctacctgagcctgacgcccgagcagtggaagtcccacagaagctacagctgc<br>cgggtcacgcatgaagggagcaccgtggagaagacagtggcccctgcagaatgctct<br>SEQ ID NO: 130 |
| Sequence 28 | N49P62 | caggtgcgacttcagcagtctggtgtcgtggtgaggaagcctggggcctcagtgagactttc<br>ctgcgagacgtctggattcaaattcatcgaccacattgtcaactgggtgcggcgggcccctg<br>gacgaggctttgaatggatgggttggatcaagcctcttgggggtgtcgctgattatgcaccc<br>caacatcggggcaggatctcactgacgagggacatttacactgaaaccgtctttatagacct<br>gagtcgactgacgtctggcgacacggcgatttatttctgttgtaaggccgccgcccctgatg<br>aagcattccccccttgaatactggggccaggggacccaacttatcgtctcccggcctccacc<br>aagggcccatcggtcttcccctggcaccctcctccaagagcacctctgggggcacagcggc<br>cctgggctgcctggtcaaggactacttccccgaaccggtgacggtgtcgtggaactcaggcg<br>ccctgaccagcggcgtgcacaccttcccggctgtcctacagtcctcaggactctactccctc<br>agcagcgtggtgaccgtgccctccagcagcttgggcacccagacctacatctgcaacgtgaa<br>tcacaagcccagcaacaccaaggtggacaagaaagttgagcccaaatcttgtgacaaaactc<br>acacatgcccaccgtgcccagcacctgaactcctggggggaccgtcagtcttcctcttcccc<br>ccaaaacccaaggacaccctcatgatctcccggacccctgaggtcacatgcgtggtggtgga<br>cgtgagccacgaagaccctgaggtcaagttcaactggtacgtggacggcgtggaggtgcata<br>atgccaagacaaagccgcgggaggagcagtacaacagcacgtaccgggtggtcagcgtcctc<br>accgtcctgcaccaggactggctgaatggcaaggagtacaagtgcaaggtctccaacaaagc<br>cctcccagcccccatcgagaaaaccatctccaaagccaaagggcagccccgagaaccacagg<br>tgtacaccctgcccccatcccgggatgagctgaccaagaaccaggtcagcctgacctgcctg<br>gtcaaaggcttctatcccagcgacatcgccgtggagtgggagagcaatgggcagccggagaa<br>caactacaagaccacgcctcccgtgctggactccgacggctccttcttcctctacagcaagc<br>tcaccgtggacaagagcaggtggcagcaggggaacgtcttctcatgctccgtgatgcatgag<br>gctctgcacaaccactacacgcagaagagcctctccctgtctccgggtaaa<br>SEQ ID NO: 131 |
| | | caggctgccctgactcagcccgcctccgtgtccggctctcctggacagtcggtcaccatttc<br>ctgcctttatgccaatgtagatatctgctggtatcaaatacagccgggcagattacccaaac<br>ttctgattgttgacaataataggcgaccctcaggagtctctcctcgcttctctggctccaag<br>tctggcaccacggcctccctgacaatctctggacttcaggctgacgacgaggctgaatatca<br>ctgctcttcaacaacatttttttggcgggggaccaagttgaccgtcctcagtcagcccaagg<br>ctgcccctcggtcactctgttcccaccctcctctgaggagcttcaagccaacaaggccaca<br>ctggtgtgtctcgtaagtgacttctacccgggagccgtgacagtggcctggaaggcagatgg<br>cagccccgtcaaggtgggagtggagaccaccaaaccctccaaacaaagcaacaacaagtatg<br>cggccagcagctacctgagcctgacgcccgagcagtggaagtcccacagaagctacagctgc<br>cgggtcacgcatgaagggagcaccgtggagaagacagtggcccctgcagaatgctct<br>SEQ ID NO: 132 |

TABLE 2-continued

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| Sequence 29 | N49P63 | caggtgcgacttgtgcagtctggtcccgtgatgagaaagcctggggcctcagtgagaatttc<br>ttgcgagacatctggattcgccttcttggaccacattgtccactgggtgcggcgggcccctg<br>gacgcggctttgaatggatgggttgggttaagaccattgggggtgtcgttgattatgcaccc<br>caccttaggggcaggatctccgtgacgagagacgtctttagtgaaaccgtctttctggactt<br>gagtcgactgacgtctggcgacacggcgatgtattttttgttctaaggccgccgcccctgacg<br>aagccttccccttgaattttggggcaggggacccaagtcatcgtctcctcggcctccacc<br>aagggcccatcggtcttcccctggcaccctcctccaagagcacctctggggggcacagcggc<br>cctgggctgcctggtcaaggactacttccccgaaccggtgacggtgtcgtggaactcaggcg<br>ccctgaccagcggcgtgcacaccttcccggctgtcctacagtcctcaggactctactccctc<br>agcagcgtggtgaccgtgccctccagcagcttgggcacccagacctacatctgcaacgtgaa<br>tcacaagcccagcaacaccaaggtggacaagaaagttgagcccaaatcttgtgacaaaactc<br>acacatgcccaccgtgcccagcacctgaactcctggggggaccgtcagtcttcctcttcccc<br>ccaaaacccaaggacaccctcatgatctcccggacccctgaggtcacatgcgtggtggtgga<br>cgtgagccacgaagaccctgaggtcaagttcaactggtacgtggacggcgtggaggtgcata<br>atgccaagacaaagccgcggggaggagcagtacaacagcacgtaccgggtggtcagcgtcctc<br>accgtcctgcaccaggactggctgaatggcaaggagtacaagtgcaaggtctccaacaaagc<br>cctcccagccccatcgagaaaaccatctccaaagccaaagggcagccccgagaaccacagg<br>tgtacaccctgcccccatcccgggatgagctgaccaagaaccaggtcagcctgacctgcctg<br>gtcaaaggcttctatcccagcgacatcgccgtggagtgggagagcaatgggcagccggagaa<br>caactacaagaccacgcctcccgtgctggactccgacggctccttcttcctctacagcaagc<br>tcaccgtggacaagagcaggtggcagcaggggaacgtcttctcatgctccgtgatgcatgag<br>gctctgcacaaccactacacgcagaagagcctctccctgtctccgggtaaa<br>SEQ ID NO: 133<br>---<br>caggctgccctgactcagcccgcctccgtgtccggctctcctggacagtcggtcaccatttc<br>ttgccttatgccaatgtggatatctgctggtatcaacttcacccgggcagagccccaaac<br>ttcttattcttgacaataataaaacggccctcaggagtctctagtcgcttctccggttccaag<br>tctggcaccacggcctccctaaccatctctgaccttcaggctgacgacgaggctgaatatca<br>ctgctcttcaacaacatttttttggcggggggaccaggttgaccgtcctgagtcagcccaagg<br>ctgcccctcggtcactctgttcccacccctctgaggagcttcaagccaacaaggccaca<br>ctggtgtgtctcgtaagtgacttctacccgggagccgtgacagtggcctggaaggcagatgg<br>cagcccgtcaaggtgggagtggagaccaccaaacccctccaaacaaagcaacaacaagtatg<br>cggccagcagctacctgagcctgacgcccgagcagtggaagtcccacagaagctacagctgc<br>cgggtcacgcatgaagggagcaccgtggagaagacagtggcccctgcagaatgctct<br>SEQ ID NO: 134 |
| Sequence 30 | N49P64 | caggtgcgacttgtgcagtctggtcccgtggtgagaaagcctgggacctcagtgagaatttc<br>ttgcgagacatctggattcgccttcttggaccacattgtccactgggtcggcgggcccctg<br>gacgcggctttgaatggatgggttgggttaagaccattgggggtgtcgttgattatgcaccc<br>caccttaggggcaggatctccgtgacgagggacgtatttagtgaaatcgtctttatggagtt<br>gagtcgactgacgtctggcgacacggcgatgtattttttgttctaaggccgccgcccctgacg<br>aagccttccccttgaattttggggcaggggacccaagtcatcgtctcctcggcctccacc<br>aagggcccatcggtcttcccctggcaccctcctccaagagcacctctggggggcacagcggc<br>cctgggctgcctggtcaaggactacttccccgaaccggtgacggtgtcgtggaactcaggcg<br>ccctgaccagcggcgtgcacaccttcccggctgtcctacagtcctcaggactctactccctc<br>agcagcgtggtgaccgtgccctccagcagcttgggcacccagacctacatctgcaacgtgaa<br>tcacaagcccagcaacaccaaggtggacaagaaagttgagcccaaatcttgtgacaaaactc<br>acacatgcccaccgtgcccagcacctgaactcctggggggaccgtcagtcttcctcttcccc<br>ccaaaacccaaggacaccctcatgatctcccggacccctgaggtcacatgcgtggtggtgga<br>cgtgagccacgaagaccctgaggtcaagttcaactggtacgtggacggcgtggaggtgcata<br>atgccaagacaaagccgcggggaggagcagtacaacagcacgtaccgggtggtcagcgtcctc<br>accgtcctgcaccaggactggctgaatggcaaggagtacaagtgcaaggtctccaacaaagc<br>cctcccagccccatcgagaaaaccatctccaaagccaaagggcagccccgagaaccacagg<br>tgtacaccctgcccccatcccgggatgagctgaccaagaaccaggtcagcctgacctgcctg<br>gtcaaaggcttctatcccagcgacatcgccgtggagtgggagagcaatgggcagccggagaa<br>caactacaagaccacgcctcccgtgctggactccgacggctccttcttcctctacagcaagc<br>tcaccgtggacaagagcaggtggcagcaggggaacgtcttctcatgctccgtgatgcatgag<br>gctctgcacaaccactacacgcagaagagcctctccctgtctccgggtaaa<br>SEQ ID NO: 135<br>---<br>caggctgccctgactcagcccgcctccgtgtccggctctcctggacagtcggtcaccatttc<br>ctgcctttatgccaatgtggatatctgctggtatcaacttcacccgggcagagccccaaac<br>ttctaattgttgacaataataagcggccctcaggagtctctagtcgcttctctggttccaag<br>tctggcaccacggcctccctaacaatctctgatcttcaggctgacgacgaggctgaatatca<br>ctgctcttcaacaacatttttttggcggggggaccaggttgaccgtcctgagtcagcccaagg<br>ctgcccctcggtcactctgttcccacccctctgaggagcttcaagccaacaaggccaca<br>ctggtgtgtctcgtaagtgacttctacccgggagccgtgacagtggcctggaaggcagatgg<br>cagcccgtcaaggtgggagtggagaccaccaaacccctccaaacaaagcaacaacaagtatg |

TABLE 2-continued

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| | | cggccagcagctacctgagcctgacgcccgagcagtggaagtcccacagaagctacagctgc cgggtcacgcatgaagggagcaccgtggagaagacagtggcccctgcagaatgctct<br>SEQ ID NO: 136 |
| Sequence 31 | N49P65 | caagtgcaactggtgcagtctggggctggggtgaagaagcctggggcctcagtgagggtctc ctgcgagacatccggattcaagttcaccgagtactttatccactttttacgacaggcccctg gacaagggcttgagtggatgggatggctcaaccctctcagaggtgccgtcaactatccacgg aagtttcagggcagagtcactttgaccagggacatctacaccaccaccgtctacatgcaact taacggtctgacccctgacgacacggccgtctactactgtgccagagcggtctttaatgaag ctttccccttttgactactggggccagggaagcctggtcaccgtctcctcagcctccaccaag ggcccatcggtcttccccctggcaccctcctccaagagcacctctgggggcacagcggccct gggctgcctggtcaaggactacttccccgaaccggtgacggtgtcgtggaactcaggcgccc tgaccagcggcgtgcacaccttcccggctgtcctacagtcctcaggactctactccctcagc agcgtggtgaccgtgccctccagcagcttgggcacccagacctacatctgcaacgtgaatca caagcccagcaacaccaaggtggacaagaaagttgagcccaaatcttgtgacaaaactcaca catgcccaccgtgcccagcacctgaactcctggggggaccgtcagtcttcctcttcccccca aaacccaaggacaccctcatgatctcccggacccctgaggtcacatgcgtggtggtggacgt gagccacgaagaccctgaggtcaagttcaactggtacgtggacggcgtggaggtgcataatg ccaagacaaagccgcgggaggagcagtacaacagcacgtaccgggtggtcagcgtcctcacc gtcctgcaccaggactggctgaatggcaaggagtacaagtgcaaggtctccaacaaagccct cccagcccccatcgagaaaaccatctccaaagccaaagggcagccccgagaaccacaggtgt acaccctgcccccatcccgggatgagctgaccaagaaccaggtcagcctgacctgcctggtc aaaggcttctatcccagcgacatcgccgtggagtgggagagcaatgggcagccggagaacaa ctacaagaccacgcctcccgtgctggactccgacggctccttcttcctctacagcaagctca ccgtggacaagagcaggtggcagcaggggaacgtcttctcatgctccgtgatgcatgaggct ctgcacaaccactacacgcagaagagcctctccctgtctccgggtaaa<br>SEQ ID NO: 137 |
| | | tcctgggcccagactcagcctgcctccgtgtctgggtctcctggacagtcgatcaccatctc ctgcgctggaatcgtcagtgatgcctggtaccagcaataccaggcagacccccagactca tcctttatgacggcgataagcggccctcaggggtttctcctcgttttctgcctccagggcc ggcaagacgcctccctgacaatttctgggctgcaggctgacgacgaggcttattatcactg cgcgtcaagggaattttttggaggcgtgaccaagttgaccgtcctaagtcagcccaaggctg cccccctcggtcactctgttcccaccctcctctgaggagcttcaagccaacaaggccacactg gtgtgtctcgtaagtgacttctacccgggagccgtgacagtggcctggaaggcagatggcag ccccgtcaaggtgggagtggagaccaccaaaccctccaaacaaagcaacaagtatgcgg ccagcagctacctgagcctgacgcccgagcagtggaagtcccacagaagctacagctgccgg gtcacgcatgaagggagcaccgtggagaagacagtggcccctgcagaatgctct<br>SEQ ID NO: 138 |
| Sequence 32 | N49P66 | caggtgcgacttcagcagtctggtgtcgtggtgaggaagcctggggcctcagtgagacttc ctgcgagacgtctggcttcaaattcatcgaccacattgtcaactgggtgcggcgggcccctg gacgaggctttgaatggatgggttggatcaagcctcttggggtgtcgctgattatgcaccc caacatcggggcaggatctcactgacgagggacatttacactgaaaccgtctttatagacct gagtcgactgacgtctggcgacacggcgatttattttgttgtaaggccgccgcccctgatg aagcattccccccttgaatactggggccaggggacccaacttatcgtctcccggcctccacc aagggcccatcggtcttccccctggcaccctcctccaagagcacctctgggggcacagcggc cctgggctgcctggtcaaggactacttccccgaaccggtgacggtgtcgtggaactcaggcg ccctgaccagcggcgtgcacaccttcccggctgtcctacagtcctcaggactctactccctc agcagcgtggtgaccgtgccctccagcagcttgggcacccagacctacatctgcaacgtgaa tcacaagcccagcaacaccaaggtggacaagaaagttgagcccaaatcttgtgacaaaactc acacatgcccaccgtgcccagcacctgaactcctggggggaccgtcagtcttcctcttccc ccaaaacccaaggacaccctcatgatctcccggacccctgaggtcacatgcgtggtggtgga cgtgagccacgaagaccctgaggtcaagttcaactggtacggcgtggaggtgcata atgccaagacaaagccgcgggaggagcagtacaacagcacgtaccgggtggtcagcgtcctc accgtcctgcaccaggactggctgaatggcaaggagtacaagtgcaaggtctccaacaaagc cctcccagcccccatcgagaaaaccatctccaaagccaaagggcagccccgagaaccacagg tgtacaccctgcccccatcccgggatgagctgaccaagaaccaggtcagcctgacctgcctg gtcaaaggcttctatcccagcgacatcgccgtggagtgggagagcaatgggcagccggagaa caactacaagaccacgcctcccgtgctggactccgacggctccttcttcctctacagcaagc tcaccgtggacaagagcaggtggcagcaggggaacgtcttctcatgctccgtgatgcatgag gctctgcacaaccactacacgcagaagagcctctccctgtctccgggtaaa<br>SEQ ID NO: 139 |
| | | caggctgccctgactcagccgcctccgtgtccggctctcctggacagtcggtcaccatttc ctgccttatgccaatgtagatatctgctggtatcaaatacagccgggcagattacccaaac ttctgattgttgacaatgataggcgacccctcaggagtctctcctcgcttctctggctccaag tctggcaccacggcctcctgacaatctctggacttcaggctgacgacgaggctgaatatca ctgctcttcaacaacatttttggcgggggaccaagttgaccgtcctcagtcagcccaagg ctgcccctcggtcactctgttcccaccctcctctgaggagcttcaagccaacaaggccaca |

TABLE 2-continued

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| | | ctggtgtgtctcgtaagtgacttctacccgggagccgtgacagtggcctggaaggcagatgg<br>cagccccgtcaaggtgggagtggagaccaccaaaccctccaaacaaagcaacaacaagtatg<br>cggccagcagctacctgagcctgacgcccgagcagtggaagtcccacagaagctacagctgc<br>cgggtcacgcatgaagggagcaccgtggagaagacagtggcccctgcagaatgctct<br>SEQ ID NO: 140 |
| Sequence 33 | N49P67 | caggtgcgacttgtgcagtctggtcccgtgatgagaaagcctggggcctcagtgagaatttc<br>ttgcgagacatctggattcgccttcttggaccacattgtccactgggtgcggcgggcccctg<br>gacgcggctttgaatggatgggttgggttaagaccattgggggtgtcgttgattatgcaccc<br>caccttaggggcaggatctccgtgacgagagacgtctttagtgaaaccgtctttctggactt<br>gagtcgactgacgtctggcgacacggcgatgtattttttgttctaaggccgccgcccctgacg<br>aagccttccccttgaattttggggccaggggacccaagtcatcgtctcctcggcctccacc<br>aagggcccatcggtcttccccctggcaccctcctccaagagcacctctgggggcacagcggc<br>cctgggctgcctggtcaaggactacttccccgaaccggtgacggtgtcgtggaactcaggcg<br>ccctgaccagcggcgtgcacaccttcccggctgtcctacagtcctcaggactctactccctc<br>agcagcgtggtgaccgtgccctccagcagcttgggcacccagacctacatctgcaacgtgaa<br>tcacaagcccagcaacaccaaggtggacaagaaagttgagcccaaatcttgtgacaaaactc<br>acacatgcccaccgtgcccagcacctgaactcctggggggaccgtcagtcttcctcttcccc<br>ccaaaacccaaggacaccctcatgatctcccggacccctgaggtcacatgcgtggtggtgga<br>cgtgagccacgaagaccctgaggtcaagttcaactggtacgtggacggcgtggaggtgcata<br>atgccaagacaaagccgcgggaggagcagtacaacagcacgtaccgggtggtcagcgtcctc<br>accgtcctgcaccaggactggctgaatggcaaggagtacaagtgcaaggtctccaacaaagc<br>cctcccagcccccatcgagaaaaccatctccaaagccaaagggcagccccgagaaccacagg<br>tgtacaccctgcccccatcccgggatgagctgaccaagaaccaggtcagcctgacctgcctg<br>gtcaaaggcttctatcccagcgacatcgccgtggagtgggagagcaatgggcagccggagaa<br>caactacaagaccacgcctcccgtgctggactccgacggctccttcttcctctacagcaagc<br>tcaccgtggacaagagcaggtggcagcaggggaacgtcttctcatgctccgtgatgcatgag<br>gctctgcacaaccactacacgcagaagagcctctccctgtctccgggtaaa<br>SEQ ID NO: 141 |
| | | caggctgccctgactcagcccgcctccgtgtccggctctcctggacagtcggtcaccatttc<br>ttgcctttatgccaatgtggatatctgctggtatcaacttcacccgggcagagcccccaaac<br>ttctaattcttgacaataataaacggccctcaggagtctctagtcgcttctccggttccaag<br>tctggcaccacggcctcctaaccatctctgaccttcaggctgacgacgaggctgaatatca<br>ctgctcttcaacaacttttttttggcggggggaccaggttgaccgtcctgagtcagcccaagg<br>ctgcccctcggtcactctgttcccaccctcctctgaggagcttcaagccaacaaggccaca<br>ctggtgtgtctcgtaagtgacttctacccgggagccgtgacagtggcctggaaggcagatgg<br>cagccccgtcaaggtgggagtggagaccaccaaaccctccaaacaaagcaacaacaagtatg<br>cggccagcagctacctgagcctgacgcccgagcagtggaagtcccacagaagctacagctgc<br>cgggtcacgcatgaagggagcaccgtggagaagacagtggcccctgcagaatgctct<br>SEQ ID NO: 142 |
| Sequence 34 | N49P68 | cacgtgcagttgaggcagtctgggactgaggcgaagaagtctggggcctcggtgacaatctc<br>ttgtgagaccgctggattcaacttcatcgactccgtcatacactggctgcgccaggcccctg<br>gtgggggatttcagtggatggggtggatcaagcctcttagaggtggcgtcaattatccacat<br>tatttgcagggcagaatctccatgacccgggacttgtccagtgacacggtttacatggtctt<br>aaatagactgacacctgccgacacaggcctttattactgcgcgaaagggggcctttggggga<br>gttctcccttttggcttctggggccagggaactctgctcaccgtctccccagcctccaccaag<br>ggcccatcggtcttccccctggcaccctcctccaagagcacctctgggggcacagcggccct<br>gggctgcctggtcaaggactacttccccgaaccggtgacggtgtcgtggaactcaggcgccc<br>tgaccagcggcgtgcacaccttcccggctgtcctacagtcctcaggactctactccctcagc<br>agcgtggtgaccgtgccctccagcagcttgggcacccagacctacatctgcaacgtgaatca<br>caagcccagcaacaccaaggtggacaagaaagttgagcccaaatcttgtgacaaaactcaca<br>catgcccaccgtgcccagcacctgaactcctggggggaccgtcagtcttcctcttcccccca<br>aaacccaaggacaccctcatgatctcccggacccctgaggtcacatgcgtggtggtggacgt<br>gagccacgaagaccctgaggtcaagttcaactggtacgtggacggcgtggaggtgcataatg<br>ccaagacaaagccgcgggaggagcagtacaacagcacgtaccgggtggtcagcgtcctcacc<br>gtcctgcaccaggactggctgaatggcaaggagtacaagtgcaaggtctccaacaaagccct<br>cccagcccccatcgagaaaaccatctccaaagccaaagggcagccccgagaaccacaggtgt<br>acaccctgcccccatcccgggatgagctgaccaagaaccaggtcagcctgacctgcctggtc<br>aaaggcttctatcccagcgacatcgccgtggagtgggagagcaatgggcagccggagaacaa<br>ctacaagaccacgcctcccgtgctggactccgacggctccttcttcctctacagcaagctca<br>ccgtggacaagagcaggtggcagcaggggaacgtcttctcatgctccgtgatgcatgaggct<br>ctgcacaaccactacacgcagaagagcctctccctgtctccgggtaaa<br>SEQ ID NO: 143 |
| | | cagtctgccctgtctcagcctgtctccgtgtctgggtctcctggagagtcgatcaccatttc<br>ctgtactgaagccaccacctggtatcaacaactcccaggcaaaccccccaaactcatcattt<br>atgacgtgaccaaccggccctcaggcatttcaagtcgtttctctggctccatgtctggtcgc |

TABLE 2-continued

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| | | acggcctccctgacaatctccggtctccaggttgacgacgagggtctctatcactgtgcctc<br>acgtgaattttcggcgggggaccaagctgaccgtcctgagtcagcccaaggctgccccct<br>cggtcactctgttcccaccctcctctgaggagcttcaagccaacaaggccacactggtgtgt<br>ctcgtaagtgacttctacccgggagccgtgacagtggcctggaaggcagatggcagcccgt<br>caaggtgggagtggagaccaccaaaccctccaaacaaagcaacaacaagtatgcggccagca<br>gctacctgagcctgacgcccgagcagtggaagtcccacagaagctacagctgccgggtcacg<br>catgaagggagcaccgtggagaagacagtggcccctgcagaatgctct<br>SEQ ID NO: 144 |
| Sequence 35 | N49P69 | cacgtgcaattgatgcagtctgggactcaggcgaagaagtctggggcctcggtgacaatttc<br>ttgtgagaccgctggattcaagttcatcgactccgtcatacactggctgcgccaggcccctg<br>gagggggatttcagtggatggggtggatcaagcctcttggaggtgccgtcaactatccaccc<br>tatttgcagggcaggatctccttgacccgtgacttgtccaccgacacaatttacatggtctt<br>gaatggactgacacctgccgacacaggcttttattactgcgcaaaggggcctttgggggg<br>gttctcccttggcttctggggcagggactctgctcaccgtctcccagcctccaccaag<br>ggcccatcggtcttccccctggcaccctcctccaagagcacctctgggggcacagcggccct<br>gggctgcctggtcaaggactacttccccgaaccggtgacggtgtcgtggaactcaggcgccc<br>tgaccagcggcgtgcacaccttcccggctgtcctacagtcctcaggactctactccctcagc<br>agcgtggtgaccgtgcctccagcagcttgggcacccagacctacatctgcaacgtgaatca<br>caagcccagcaacaccaaggtggacaagaaagttgagcccaaatcttgtgacaaaactcaca<br>catgcccaccgtgcccagcacctgaactcctgggggaccgtcagtcttcctcttcccccca<br>aaacccaaggacacccctcatgatctcccggacccctgaggtcacatgcgtggtggtggacgt<br>gagccacgaagaccctgaggtcaagttcaactggtacgtggacggcgtggaggtgcataatg<br>ccaagacaaagccgcgggaggagcagtacaacagcacgtaccgggtggtcagcgtcctcacc<br>gtcctgcaccaggactggctgaatggcaaggagtacaagtgcaaggtctccaacaaagccct<br>cccagcccccatcgagaaaaccatctccaaagccaaagggcagccccgagaaccacaggtgt<br>acaccctgcccccatcccgggatgagctgaccaagaaccaggtcagcctgacctgcctggtc<br>aaaggcttctatcccagcgacatcgccgtggagtgggagcaatgggcagccggagaacaa<br>ctacaagaccacgcctcccgtgctggactccgacggctccttcttcctctacagcaagctca<br>ccgtggacaagagcaggtggcagcaggggaacgtcttctcatgctccgtgatgcatgaggct<br>ctgcacaaccactacacgcagaagagcctctccctgtctccgggtaaa<br>SEQ ID NO: 145 |
| | | cagtctgccctgtctcagcctgtctccgtgtctgggtctcctggagactcgatcaccatttc<br>ttgttttggagccaccacctggtatcaacaactcccaggcagaccccccaaactcatcatt<br>atgacgtgactaaccggccctcaggcatttcaggtcgtttctctggctccatgtctggtcaa<br>aaggcctccctgacaatctccggtctccaggttgacgacgagggtctctatcactgcgcctc<br>acgtgaattttcggcgggggaccaaactgaccgtcctgagtcagcccaaggctgccccct<br>cggtcactctgttcccaccctcctctgaggagcttcaagccaacaaggccacactggtgtgt<br>ctcgtaagtgacttctacccgggagccgtgacagtggcctggaaggcagatggcagcccgt<br>caaggtgggagtggagaccaccaaaccctccaaacaaagcaacaacaagtatgcggccagca<br>gctacctgagcctgacgcccgagcagtggaagtcccacagaagctacagctgccgggtcacg<br>catgaagggagcaccgtggagaagacagtggcccctgcagaatgctct<br>SEQ ID NO: 146 |
| Sequence 36 | N49P70 | cacgtgcagttgaggcagtctgggactgaggcgaagaagtctggggcctcggtgacaatctc<br>ttgtgagaccgctggattcaacttcatcgactccgtcatacactggctgcgccaggcccctg<br>gtggggatttcagtggatggggtggatcaagcctcttagagtgggtgtcaattatccacat<br>tatttgcagggcagaatctccatgacccgggacttgtccagtgacacggtttacatggtctt<br>aaatagactgacacctgacgacacaggcctttactactgcgcgaaagggccctttgggggga<br>gttctccccttggcttctggggccagggaactctgctcaccgtctcccagcctccaccaag<br>ggcccatcggtcttccccctggcaccctcctccaagagcacctctgggggcacagcggccct<br>gggctgcctggtcaaggactacttccccgaaccggtgacggtgtcgtggaactcaggcgccc<br>tgaccagcggcgtgcacaccttcccggctgtcctacagtcctcaggactctactccctcagc<br>agcgtggtgaccgtgccctccagcagcttgggcacccagacctacatctgcaacgtgaatca<br>caagcccagcaacaccaaggtggacaagaaagttgagcccaaatcttgtgacaaaactcaca<br>catgcccaccgtgcccagcacctgaactcctgggggaccgtcagtcttcctcttcccccca<br>aaacccaaggacacccctcatgatctcccggacccctgaggtcacatgcgtggtggtggacgt<br>gagccacgaagaccctgaggtcaagttcaactggtacgtggacggcgtggaggtgcataatg<br>ccaagacaaagccgcgggaggagcagtacaacagcacgtaccgggtggtcagcgtcctcacc<br>gtcctgcaccaggactggctgaatggcaaggagtacaagtgcaaggtctccaacaaagccct<br>cccagcccccatcgagaaaaccatctccaaagccaaagggcagccccgagaaccacaggtgt<br>acaccctgcccccatcccgggatgagctgaccaagaaccaggtcagcctgacctgcctggtc<br>aaaggcttctatcccagcgacatcgccgtggagtgggagcaatgggcagccggagaacaa<br>ctacaagaccacgcctcccgtgctggactccgacggctccttcttcctctacagcaagctca<br>ccgtggacaagagcaggtggcagcaggggaacgtcttctcatgctccgtgatgcatgaggct<br>ctgcacaaccactacacgcagaagagcctctccctgtctccgggtaaa<br>SEQ ID NO: 147 |

TABLE 2-continued

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| | | cagtctgccctgtctcagcctgtctccgtgtctgggtctcctggagagtcgatcaccatttc<br>ctgtactgaagccaccacctggtatcaacaactcccagggagatcccccaaactcattattt<br>atgacgtgaccaaccggccctcaggcatttcaagtcgtttctctggctccatgtctggtcgc<br>acggcctccctgacaatctccggtctccaggttgacgacgagggtctctatcactgtgcctc<br>acgtgaattttcggcggggggaccaagctgaccgtcctcagtcagcccaaggctgcccct<br>cggtcactctgttcccaccctcctctgaggagcttcaagcaacaaggccacactggtgtgt<br>ctcgtaagtgacttctaccgggagccgtgacagtggcctggaaggcagatggcagcccgt<br>caaggtgggagtggagaccaccaaaccctccaaacaaagcaacaacaagtatgcggccagca<br>gctacctgagcctgacgcccgagcagtggaagtcccacagaagctacagctgccgggtcacg<br>catgaagggagcaccgtggagaagacagtggcccctgcagaatgctct<br>SEQ ID NO: 148 |
| Sequence 37 | N49P71 | cgtgttacattacaacagtctggggctacagtgaggcagcctggggcctcagtcaccgtctc<br>ctgcgagacttctggattcaccttcatcaaatataccattcactgggtgcgacaggcccctg<br>gacagggtcttcagtgggtgggaagaatacaccccccgaaccggtgccgtgaagtttgcaccg<br>atatttcagggtaaattttccatgagtcgagacttgtcacgcgacacagcctacctcggatt<br>gaccagactgacactcgccgacacggctctattttctgtgcgaggggggcctttgaggcag<br>atttatatgggccaacttacccctttcaccactggggcaaggaacccaagtcaccgtctcc<br>gcggcctccaccaagggcccatcggtcttcccccctggcaccctcctccaagagcacctctgg<br>gggcacagcggccctgggctgcctggtcaaggactacttccccgaaccggtgacggtgtcgt<br>ggaactcaggcgccctgaccagcggcgtgcacaccttcccggctgtcctacagtcctcagga<br>ctctactccctcagcagcgtggtgaccgtgcctccagcagcttgggcacccagacctacat<br>ctgcaacgtgaatcacaagcccagcaacaccaaggtggacaagaaagttgagcccaaatctt<br>gtgacaaaactcacacatgcccaccgtgcccagcacctgaactcctgggggaccgtcagtc<br>ttcctcttccccccaaaacccaaggacaccctcatgatctcccggacccctgaggtcacatg<br>cgtggtggtggacgtgagccacgaagaccctgaggtcaagttcaactggtacgtggacggcg<br>tggaggtgcataatgccaagacaaagccgcgggaggagcagtacaacagcacgtaccgggtg<br>gtcagcgtcctcaccgtcctgcaccaggactggctgaatggcaaggagtacaagtgcaaggt<br>ctccaacaaagcccctcccagccccatcgagaaaaccatctccaaagccaaagggcagcccc<br>gagaaccacaggtgtacaccctgcccccatcccgggatgagctgaccaagaaccaggtcagc<br>ctgacctgcctggtcaaaggcttctatcccagcgacatcgccgtggagtgggagagcaatgg<br>gcagccggagaacaactacaagaccacgcctcccgtgctggactccgacggctccttcttcc<br>tctacagcaagctcaccgtggacaagagcaggtggcagcaggggaacgtcttctcatgctcc<br>gtgatgcatgaggctctgcacaaccactacacgcagaagagcctctccctgtctccgggtaa<br>a<br>SEQ ID NO: 149 |
| | | tcctgggccctgactcaacccgcctccgtgtctgcgtctcctgggcagtcggtcaccatgtc<br>ctgcactggattcggaagttataatcctgactcctggtaccagcaataccaggcaaagccc<br>ccaaactcatcatttatgatgacaataaaagaccctcggggtctctgatcgcttctctgct<br>ccagacttggcagcacatcttcactgacaatctctaacgtccaggccgctgacgacgcccat<br>tatgtctgcgcctcctttgagttttcggcggggggaccaagctgaccgtcctgagtcagcc<br>caaggctgcccctcggtcactctgttcccaccctcctctgaggagcttcaagcaacaagg<br>ccacactggtgtgtctcgtaagtgacttctaccgggagccgtgacagtggcctggaaggca<br>gatggcagcccgtcaaggtgggagtggagaccaccaaaccctccaaacaaagcaacaacaa<br>gtatgcggccagcagctacctgagcctgacgcccgagcagtggaagtcccacagaagctaca<br>gctgccgggtcacgcatgaagggagcaccgtggagaagacagtggcccctgcagaatgctct<br>SEQ ID NO: 150 |
| Sequence 38 | N49P72 | cacattcagttgctacagtcggggcctcaagttaagaagtctggggacacagtgagaatctc<br>ctgtgagacctctggatataatttcgtcgactcccttatccactgggtccgacagacccgg<br>aaaaacgtctcagatggatgggctggatcaatcctctccaaggtggtgtgaattacgcgcg<br>gaatttcagggcagaatcaggatgaccagggacacgtttatagacacagtttacgtggactt<br>gagcggactgacaccggccgacacggcctattattactgcgcgcgagggatcgatggcaatt<br>cttacccctttcatttctgggccacggaaccgggtcaccgtcttctcggcctccaccaag<br>ggcccatcggtcttcccccctggcaccctcctccaagagcacctctgggggcacagcggccc<br>tgggctgcctggtcaaggactacttccccgaaccggtgacggtgtcgtggaactcaggcgccc<br>tgaccagcggcgtgcacaccttcccggctgtcctacagtcctcaggactctactccctcagc<br>agcgtggtgaccgtgcctccagcagcttgggcacccagacctacatctgcaacgtgaatca<br>caagcccagcaacaccaaggtggacaagaaagttgagcccaaatcttgtgacaaaactcaca<br>catgcccaccgtgcccagcacctgaactcctgggggaccgtcagtcttcctcttccccca<br>aaacccaaggacaccctcatgatctcccggacccctgaggtcacatgcgtggtggtggacgt<br>gagccacgaagaccctgaggtcaagttcaactggtacgtggacggcgtggaggtgcataatg<br>ccaagacaaagccgcgggaggagcagtacaacagcacgtaccgggtcctcaccg<br>tcctgcaccaggactggctgaatggcaaggagtacaagtgcaaggtctccaacaaagccct<br>cccagccccatcgagaaaaccatctccaaagccaaagggcagccccgagaaccacaggtgt<br>acaccctgcccccatcccgggatgagctgaccaagaaccaggtcagcctgacctgcctggtc<br>aaaggcttctatcccagcgacatcgccgtggagtgggagagcaatgggcagccggagaacaa<br>ctacaagaccacgcctcccgtgctggactccgacggctccttcttcctctacagcaagctca |

TABLE 2-continued

Amino acid sequence of natural antibodies. Heavy chain is shown first (above dotted line), followed by the light chain (below dotted line). Sequences of CDRH1, CDRH2, CDRH3, CDRL1, CDRL2, and CDRL3 are in bold. Note that there is a predicted 5 blank CDR in the light chain for Sequences 25, 34 and 36.

| Natural antibody | Related variants | Nucleotide sequence |
|---|---|---|
| | | ccgtggacaagagcaggtggcagcaggggaacgtcttctcatgctccgtgatgcatgaggct<br>ctgcacaaccactacacgcagaagagcctctccctgtctccgggtaaa<br>SEQ ID NO: 151 |
| | | ---------------------------------------------------------------- |
| | | cgatttgccctgactcaacctgcctccgtgtctgggtctcctggacagacgatcaccataac<br>ctgcgctggaggcagcgtctcctggttccatttccctccaggcaaaaccccagactcatta<br>tttatgagtcttctaagagaccctcaggggtctctcctcgattctctgggtcccagtctggc<br>agcacggcctcctaataatttctggcctccagtctgatgacgaagggacatacttctgttc<br>tattcttgaattttcggcagagggactcttctcaccgtcctgagtcagcccaaggctgccc<br>cctcggtcactctgttcccaccctcctctgaggagcttcaagccaacaaggccacactggtg<br>tgtctcgtaagtgacttctacccgggagccgtgacagtggcctggaaggcagatggcagccc<br>cgtcaaggtgggagtggagaccaccaaacctccaaacaaagcaacaacaagtatgcggcca<br>gcagctacctgagcctgacgcccgagcagtggaagtcccacagaagctacagctgccgggtc<br>acgcatgaagggagcaccgtggagaagacagtggcccctgcagaatgctct<br>SEQ ID NO: 152 |

TABLE 3

Nucleotide sequences of natural antibodies. Heavy chain is shown first (above dotted line), followed by the light chain (below dotted line).

| mAb | Related to sequence | Heavy chain mutation | Light chain mutations | Swaps |
|---|---|---|---|---|
| N49P6 | 1 | CH1: 1.4A, 120R<br>CH3: 12 E, 14M | Constant: 1.5G | LC7 swap |
| N49P6.2 | 1 | CH1: 120R<br>CH3: 12 E, 14M | | |
| N49P7 | 2 | CH1: 1.4A, 120R<br>CH3: 12 E, 14M | Constant: 1.5G | |
| N49P7.1 | 2 | CH1: 120R<br>CH3: 12 E, 14M | | |
| N49P7A | 2 | CH1: 1.4A, 120R<br>CH3: 12 E, 14M | Variable: 42A<br>Constant: 1.5G | |
| N49P7F | 2 | CH1: 1.4A, 120R<br>CH3: 12 E, 14M | Variable: 42F<br>Constant: 1.5G | |
| N49P7S | 2 | CH1: 1.4A, 120R<br>CH3: 12 E, 14M | Variable: 42S<br>Constant: 1.5G | |
| N49P7Y | 2 | CH1: 1.4A, 120R<br>CH3: 12 E, 14M | Variable: 42Y<br>Constant: 1.5G | |
| N49P7-54TY | 2 | Variable: 59T/62Y<br>CH1: 1.4A, 120R<br>CH3: 12 E, 14M | Constant: 1.5G | |
| N49P7LS-1 | 2 | CH1: 1.4A, 120R<br>CH3: 12 E, 14M,<br>107L, 114S | Constant: 1.5G | |
| N49P7LS-2 | 2 | CH1: 1.4A, 120R<br>CH3: 107L, 114S | Constant: 1.5G | |
| N49P7YTE | 2 | CH1: 1.4A, 120R<br>CH2: 15.1 Y,<br>16T, 18E | Constant: 1.5G | |
| N49P7L6 | 2, 1 | CH1: 1.4A, 120R<br>CH3: 12 E, 14M | Constant: 1.5G | N49P7 heavy chain with N49P6 light chain |
| N49P7L11 | 2, 4 | CH1: 1.4A, 120R<br>CH3: 12 E, 14M | | N49P7 heavy chain with N49P11 light chain |
| N49P7.1L9 | 2, 18 | CH1: 120R<br>CH3: 12 E, 14M | | N49P7.1 heavy chain with N49P9 light chain |
| N49P7.1L19 | 2, 7 | CH1: 120R<br>CH3: 12 E, 14M | | N49P7 heavy chain with N49P19 light chain |
| R49P7 | 2 | CH1: 1.4A | Constant: 1.5G | Rhesus IgG1, Rhesus LC3 |

TABLE 3-continued

Nucleotide sequences of natural antibodies. Heavy chain is shown first (above dotted line), followed by the light chain (below dotted line).

| mAb | Related to sequence | Heavy chain mutation | Light chain mutations | Swaps |
|---|---|---|---|---|
| N49P7.2 | 3 | CH1: 120R<br>CH3: 12 E, 14M | | |
| N49P11 | 4 | CH1: 120R<br>CH3: 12 E, 14M | | |
| N49P18 | 5 | CH1: 120R<br>CH3: 12 E, 14M | | |
| N49P18.2 | 5 | CH1: 120R<br>CH3: 12 E, 14M | | LC7 swap |
| N49P18.1 | 6 | CH1: 120R<br>CH3: 12 E, 14M | | |
| N49P19 | 7 | CH1: 120R<br>CH3: 12 E, 14M | | |
| N49P37 | 8 | CH1: 1.4A,120R<br>CH3: 12 E, 14M | Constant: 1.5G | |
| N49P38 | 9 | CH1: 120R<br>CH3: 12 E, 14M | Constant: 1.5G | |
| N4938.1 | 9 | CH1: 120R<br>CH3: 12 E, 14M | | |
| N49P55 | 10 | CH1: 120R<br>CH3: 12 E, 14M | | |
| N49P56 | 11 | CH1: 120R<br>CH3: 12 E, 14M | | |
| N49P57 | 12 | CH1: 120R<br>CH3: 12 E, 14M | | |
| N49P58 | 13 | CH1: 120R<br>CH3: 12 E, 14M | | |
| N49P59 | 14 | CH1: 120R<br>CH3: 12 E, 14M | | |
| N49P73 | 15 | CH1: 120R<br>CH3: 12 E, 14M | | |
| N49P74 | 16 | CH1: 120R<br>CH3: 12 E, 14M | | |
| N49P75 | 17 | CH1: 120R<br>CH3: 12 E, 14M | | |
| N49P75.1 | 17 | CH1: 1.4A, 120R<br>CH3: 12 E, 14M | Constant: 1.5G | |
| N49P9 | 18 | CH1: 120R<br>CH3: 12 E, 14M | | |
| N49P9.1 | 18 | CH1: 120R<br>CH3: 12 E, 14M | | LC2 swap |
| N49P9.2 | 18 | CH1: 1.4A, 120R<br>CH3: 12 E, 14M | Constant: 1.5G | |
| N49P9i7 | 18, 2 | CH1: 120R<br>CH3: 12 E, 14M | | Part of CDRH3 of N49P7 swapped for entire CDRH3 of N49P9 |
| N49P9i7H1 | 18, 2 | CH1: 120R<br>CH3: 12 E, 14M | | CDRH3 of N49P7 swapped for CDRH3 of N49P9 |
| N49P9i7H2 | 18, 2 | CH1: 1.4S,120R<br>CH3: 12 E, 14M | Constant: 1.5R | CDRH3 and junction of N49P7 swapped for CDRH3 of N49P9 |
| N49P22 | M9 | CH1: 120R<br>CH3: 12 E, 14M | | |
| N49P23 | 20 | CH1: 120R<br>CH3: 12 E, 14M | | |
| N49P9.3 | 21 | CH1: 120R<br>CH3: 12 E, 14M | Constant: 1.5R | |
| N49P9.4 | 21 | CH1: 120R<br>CH3: 12 E, 14M | | |
| N49P51 | 22 | CH1: 120R<br>CH3: 12 E, 14M | | |
| N49P52 | 23 | CH1: 120R<br>CH3: 12 E, 14M | | |
| N49P53 | 24 | CH1: 120R<br>CH3: 12 E, 14M | | |
| N49P54 | 25 | CH1: 120R<br>CH3: 12 E, 14M | | |
| N49P60 | 26 | CH1: 120R<br>CH3: 12 E, 14M | | |
| N49P61 | 27 | CH1: 120R<br>CH3: 12 E, 14M | | |

TABLE 3-continued

Nucleotide sequences of natural antibodies. Heavy chain is shown first (above dotted line), followed by the light chain (below dotted line).

| mAb | Related to sequence | Heavy chain mutation | Light chain mutations | Swaps |
|---|---|---|---|---|
| N49P62 | 28 | CH1: 120R<br>CH3: 12 E, 14M | | |
| N49P63 | 29 | CH1: 120R<br>CH3: 12 E, 14M | | |
| N49P64 | 30 | CH1: 120R<br>CH3: 12 E, 14M | | |
| N49P65 | 31 | CH1: 120R<br>CH3: 12 E, 14M | | |
| N49P66 | 32 | CH1: 120R<br>CH3: 12 E, 14M | | |
| N49P67 | 33 | CH1: 120R<br>CH3: 12 E, 14M | | |
| N49P68 | 34 | CH1: 120R<br>CH3: 12 E, 14M | | |
| N49P69 | 35 | CH1: 120R<br>CH3: 12 E, 14M | | |

TABLE 4

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

>N49P6
HEAVY CHAIN

AGLMQSGAVMKNSGASVRVSCQAD*GYDFIDYV* *IHWFRQRRGEGLEWLGW**MNPSGGGT**YPRPFQGK*
*VTMTRDTSTETAYLDVRGLTYDDTAVYYC**VRDRANGSGRRRFESVNWFLDL**WGRGTQITVVS*ASTKG
PSVFPLAPSSKSTSGGTAALGCLVKDYFPEPVTVSWNSGALTSGVHTFPAVLQSSGLYSLSSVVTVP
SSSLGTQTYICNVNHKPSNTKVDKRVEPKSCDKTHTCPPCPAPELLGGPSVFLPPKPKDTLMISRT
PEVTCVVVDVSHEDPEVKFNWYVDGVEVHNAKTKPREEQYNSTYRVVSVLTVLHQDWLNGKEY
KCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK
SEQ ID NO: 153

```
GCGGGACTGATGCAGTCTGGGGCTGTGATGAAGAATTCGGGGGCCTCAGTGAGGGTCTCTTGT
CAGGCTGATGGATACGACTTCATTGACTATGTCATTCACTGGTTTCGACAAAGACGTGGAGAA
GGTCTTGAGTGGCTGGGATGGATGAATCCCTCGGGAGGCGGCACAAACTATCCGCGACCATTT
CAGGGCAAAGTCACCATGACCAGGGACACGTCCACCGAGACAGCCTATTTAGATGTCAGAGG
ACTTACATATGACGACACGGCCGTCTATTATTGTGTGAGAGACAGGGCCAACGGTTCGGGAA
GAAGACGTTTTGAGTCGGTGAATTGGTTCCTGGATCTGTGGGGCCGCGGCACCCAAATAACAG
TCGTCTCGGCCTCCACCAAGGGCCCATCGGTCTTCCCCCTGGCACCCTCCTCCAAGAGCACCTC
TGGGGGCACAGCGGCCCTGGGCTGCCTGGTCAAGGACTACTTCCCCGAACCGGTGACGGTGTC
GTGGAACTCAGGCGCCCTGACCAGCGGCGTGCACACCTTCCCGGCTGTCCTACAGTCCTCAGG
ACTCTACTCCCTCAGCAGCGTGGTGACCGTGCCCTCCAGCAGCTTGGGCACCCAGACCTACAT
CTGCAACGTGAATCACAAGCCCAGCAACACCAAGGTGGACAAGAGAGTTGAGCCCAAATCTT
GTGACAAAACTCACACATGCCCACCGTGCCCAGCACCTGAACTCCTGGGGGGACCGTCAGTCT
TCCTCTTCCCCCCAAAACCCAAGGACACCCTCATGATCTCCCGGACCCCTGAGGTCACATGCG
TGGTGGTGGACGTGAGCCACGAAGACCCTGAGGTCAAGTTCAACTGGTACGTGGACGGCGTG
GAGGTGCATAATGCCAAGACAAAGCCGCGGGAGGAGCAGTACAACAGCACGTACCGGGTGG
TCAGCGTCCTCACCGTCCTGCACCAGGACTGGCTGAATGGCAAGGAGTACAAGTGCAAGGTCT
CCAACAAAGCCCTCCCAGCCCCCATCGAGAAAACCATCTCCAAAGCCAAAGGGCAGCCCCGA
GAACCACAGGTGTACACCCTGCCCCCATCCCGGGAGGAGATGACCAAGAACCAGGTCAGCCT
GACCTGCCTGGTCAAAGGCTTCTATCCCAGCGACATCGCCGTGGAGTGGGAGAGCAATGGGC
AGCCGGAGAACAACTACAAGACCACGCCTCCCGTGCTGGACTCCGACGGCTCCTTCTTCCTCT
ACAGCAAGCTCACCGTGGACAAGAGCAGGTGGCAGCAGGGGAACGTCTTCTCATGCTCCGTG
ATGCATGAGGCTCTGCACAACCACTACACGCAGAAGAGCCTCTCCCTGTCTCCGGGTAAA
SEQ ID NO: 154
```

LIGHT CHAIN

*QSALTQPRSVSASPGQSVTISCTGT**HNYVSWCQQKPGQAPKLLIYDFN**KRPSGVSDRFSGSTSGNTASLTI*
*SGLQADDEGHYFC**WAFE**NIGGGTKLTVL*GQPKAAPSVTLFPPSSEELQANKATLVCLVSDFYPGAV

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

TVAWKADGSPVKVGVETTKPSKQSNNKYAASSYLSLTPEQWKSHRSYSCRVTHEGSTVEKTVAP
AECS
SEQ ID NO: 155

CAGTCTGCCCTAACTCAGCCTCGCTCAGTGTCCGCATCTCCTGGTCAGTCAGTCACCATCTCCT
GCACTGGAACACACAATTATGTGTCCTGGTGTCAACAGAAACCGGGCCAAGCCCCCAAATTAT
TAATTTACGATTTCAATAAACGGCCCTCAGGGGTCTCTGATCGCTTCTCTGGCTCCACGTCTGG
CAACACGGCCTCCCTGACCATCTCTGGACTCCAGGCTGACGATGAGGGTCATTATTTTTGTTG
GGCGTTTGAAAATATCGGCGGAGGGACCAAGCTGACCGTCCTGGGTCAGCCCAAGGCTGCCC
CCTCGGTCACTCTGTTCCCACCCTCCTCTGAGGAGCTTCAAGCCAACAAGGCCACACTGGTGT
GTCTCGTAAGTGACTTCTACCCGGGAGCCGTGACAGTGGCCTGGAAGGCAGATGGCAGCCCC
GTCAAGGTGGGAGTGGAGACCACCAAACCCTCCAAACAAAGCAACAACAAGTATGCGGCCAG
CAGCTACCTGAGCCTGACGCCCGAGCAGTGGAAGTCCCACAGAAGCTACAGCTGCCGGGTCA
CGCATGAAGGGAGCACCGTGGAGAAGACAGTGGCCCCTGCAGAATGCTCT
SEQ ID NO: 156

>N49P6.2
HEAVY CHAIN

*AGLMQSGAVMKNSGASVRVSCQAD*GYDFIDYV*IHWFRQRRGEGLEWLGW*MNPSGGGT*NYPRPFQGK
VTMTRDTSTETAYLDVRGLTYDDTAVYYC*VRDRANGSGR*R*RFESVNWFLDL*WGRGTQITVVS*ASTKG
PSVFPLAPSSKSTSGGTAALGCLVKDYFPEPVTVSWNSGALTSGVHTFPAVLQSSGLYSLSSVVTVP
SSSLGTQTYICNVNHKPSNTKVDKRVEPKSCDKTHTCPPCPAPELLGGPSVFLFPPKPKDTLMISRT
PEVTCVVVDVSHEDPEVKFNWYVDGVEVHNAKTKPREEQYNSTYRVVSVLTVLHQDWLNGKEY
KCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK
SEQ ID NO: 157

GCGGGACTGATGCAGTCTGGGGCTGTGATGAAGAATTCGGGGGCCTCAGTGAGGGTCTCTTGT
CAGGCTGATGGATACGACTTCATTGACTATGTCATTCACTGGTTTCGACAAAGACGTGGAGAA
GGTCTTGAGTGGCTGGGATGGATGAATCCCTCGGGAGGCGGCACAAACTATCCGCGACCATTT
CAGGGCAAAGTCACCATGACCAGGGACACGTCCACCGAGACAGCCTATTTAGATGTCAGAGG
ACTTACATATGACGACACGGCCGTCTATTATTGTGTGAGAGACAGGGCCAACGGTTCGGAA
GAAGACGTTTTGAGTCGGTGAATTGGTTCCTGGATCTGTGGGGCCGCGGCACCCAAATAACAG
TCGTCTCGGCCTCCACCAAGGGCCCATCGGTCTTCCCCCTGGCACCCTCCTCCAAGAGCACCTC
TGGGGGCACAGCGGCCCTGGGCTGCCTGGTCAAGGACTACTTCCCCGAACCGGTGACGGTGTC
GTGGAACTCAGGCGCCCTGACCAGCGGCGTGCACACCTTCCCGGCTGTCCTACAGTCCTCAGG
ACTCTACTCCCTCAGCAGCGTGGTGACCGTGCCCTCCAGCAGCTTGGGCACCCAGACCTACAT
CTGCAACGTGAATCACAAGCCCAGCAACACCAAGGTGGACAAGAGAGTTGAGCCCAAATCTT
GTGACAAAACTCACACATGCCCACCGTGCCCAGCACCTGAACTCCTGGGGGGACCGTCAGTCT
TCCTCTTCCCCCCAAAACCCAAGGACACCCTCATGATCTCCCGGACCCCTGAGGTCACATGCG
TGGTGGTGGACGTGAGCCACGAAGACCCTGAGGTCAAGTTCAACTGGTACGTGGACGGCGTG
GAGGTGCATAATGCCAAGACAAAGCCGCGGGAGGAGCAGTACAACAGCACGTACCGGGTGG
TCAGCGTCCTCACCGTCCTGCACCAGGACTGGCTGAATGGCAAGGAGTACAAGTGCAAGGTCT
CCAACAAAGCCCTCCCAGCCCCCATCGAGAAAACCATCTCCAAAGCCAAAGGGCAGCCCCGA
GAACCACAGGTGTACACCCTGCCCCCATCCCGGGAGGAGATGACCAAGAACCAGGTCAGCCT
GACCTGCCTGGTCAAAGGCTTCTATCCCAGCGACATCGCCGTGGAGTGGGAGAGCAATGGGC
AGCCGGAGAACAACTACAAGACCACGCCTCCCGTGCTGGACTCCGACGGCTCCTTCTTCCTCT
ACAGCAAGCTCACCGTGGACAAGAGCAGGTGGCAGCAGGGGAACGTCTTCTCATGCTCCGTG
ATGCATGAGGCTCTGCACAACCACTACACGCAGAAGAGCCTCTCCCTGTCTCCGGGTAAA
SEQ ID NO: 158

LIGHT CHAIN

*QSALTQPRSVSASPGQSVTISCTGT*HNY*VSWCQQKPGQAPKLLIY*DFN*KRPSGVSDRFSGSTSGNTASLTI
SGLQADDEGHYFC*WAFE*NIGGGTKLTVLG*QPKAAPSVTLFPPSSEELQANKATLVCLISDFYPGAVT
VAWKADSSPVKAGVETTTPSKQSNNKYAASSYLSLTPEQWKSHRSYSCQVTHEGSTVEKTVAPTE
CS
SEQ ID NO: 159

CAGTCTGCCCTAACTCAGCCTCGCTCAGTGTCCGCATCTCCTGGTCAGTCAGTCACCATCTCCT
GCACTGGAACACACAATTATGTGTCCTGGTGTCAACAGAAACCGGGCCAAGCCCCCAAATTAT
TAATTTACGATTTCAATAAACGGCCCTCAGGGGTCTCTGATCGCTTCTCTGGCTCCACGTCTGG
CAACACGGCCTCCCTGACCATCTCTGGACTCCAGGCTGACGATGAGGGTCATTATTTTTGTTG
GGCGTTTGAAAATATCGGCGGAGGGACCAAGCTGACCGTCCTGGGTCAGCCCAAGGCTGCCC
CCTCGGTCACTCTGTTCCCGCCCTCCTCTGAGGAGCTTCAAGCCAACAAGGCCACACTGGTGT
GTCTCATAAGTGACTTCTACCCGGGAGCCGTGACAGTGGCTTGGAAAGCAGATAGCAGCCCC
GTCAAGGCGGGAGTGGAGACCACCACACCCTCCAAACAAAGCAACAACAAGTACGCGGCCA

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

```
GCAGCTATCTGAGCCTGACGCCTGAGCAGTGGAAGTCCCACAGAAGCTACAGCTGCCAGGTC
ACGCATGAAGGGAGCACCGTGGAGAAGACAGTGGCCCCTACAGAATGTTCA
SEQ ID NO: 160
```

>N49P7
HEAVY CHAIN

*ADLVQSGAVVKKPGDSVRISCEAQGYRFPDYLIHWIRRAPGQGPEWMGWMNPMGGQVNIPWKFQGR*
*VSMTRDTSIETAFLDLRGLKSDDTAVYYCVRDRSNGSGKRFESSNWFLDLWGRGTAVTIQS*A*STKGPS*
VFPLAPSSKSTSGGTAALGCLVKDYFPEPVTVSWNSGALTSGVHTFPAVLQSSGLYSLSSVVTVPSS
SLGTQTYICNVNHKPSNTKVDKRVEPKSCDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK
SEQ ID NO: 161

```
GCGGACTTGGTGCAGTCTGGGGCTGTGGTGAAGAAGCCTGGGGACTCAGTGAGGATCTCCTGT
GAGGCTCAAGGATATAGATTTCCTGACTACATCATTCACTGGATTCGACGGGCCCCTGGACAA
GGCCCTGAATGGATGGGATGGATGAATCCAATGGGCGGACAAGTAAATATTCCATGGAAATT
TCAGGGTAGGGTCTCCATGACCCGGGACACGTCCATCGAAACAGCATTTCTGGACTTAAGAGG
ACTAAAGTCTGACGACACGGCCGTCTATTATTGCGTGAGAGATCGCAGTAATGGATCGGGAA
AGCGATTCGAGTCCTCCAATTGGTTCCTCGATCTGTGGGGCCGTGGGACTGCGGTCACAATTC
AATCAGCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCGT
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGA
ACCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA
SEQ ID NO: 162
```

LIGHT CHAIN

*QSALTQPRSVSASPGQSVTISCTGTHNLVSWCQHQPGRAPKLLIYDFNKRPSGVPDRFSGSGSGGTASLT*
*ITGLQDDDDAEYFCWAYEAFGGGTKLTVLGQPKAAPSVTLFPPSSEELQANKATLVCLISDFYPGAV*
TVAWKADSSPVKAGVETTTPSKQSNNKYAASSYLSLTPEQWKSHRSYSCQVTHEGSTVEKTVAPT
ECS
SEQ ID NO: 163

```
CAGTCTGCCCTGACTCAGCCTCGCTCAGTGTCCGCATCTCCTGGGCAGTCCGTCACCATTTCCT
GCACTGGAACCCACAATTTGGTCTCTTGGTGTCAACATCAGCCAGGCAGAGCCCCCAAATTAT
TAATTTATGACTTCAATAAGAGGCCCTCAGGGGTCCCTGATCGCTTCTCTGGCTCCGGGTCTGG
CGGCACGGCCTCCCTGACCATCACTGGACTCCAGGATGACGATGACGCCGAATATTTTTGTTG
GGCGTATGAAGCTTTTGGCGGAGGGACCAAGTTGACCGTTCTTGGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 164
```

>N49P7.1
HEAVY CHAIN

*ADLVQSGAVVKKPGDSVRISCEAQGYRFPDYIIHWIRRAPGQGPEWMGWMNPMGGQVNIPWKFQGR*
*VSMTRDTSIETAFLDLRGLKSDDTAVYYCVRDRSNGSGKRFESSNWFLDLWGRGTAVTIQSS*STKGPS
VFPLAPSSKSTSGGTAALGCLVKDYFPEPVTVSWNSGALTSGVHTFPAVLQSSGLYSLSSVVTVPSS
SLGTQTYICNVNHKPSNTKVDKRVEPKSCDKTHTCPPCPAPELLGGPSVFLFPPKPKDTLMISRTPE

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

VTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK
SEQ ID NO: 165

GCGGACTTGGTGCAGTCTGGGGCTGTGGTGAAGAAGCCTGGGGACTCAGTGAGGATCTCCTGT
GAGGCTCAAGGATATAGATTTCCTGACTACATCATTCACTGGATTCGACGGGCCCCTGGACAA
GGCCCTGAATGGATGGGATGGATGAATCCAATGGGCGGACAAGTAAATATTCCATGGAAATT
TCAGGGTAGGGTCTCCATGACCCGGGACACGTCCATCGAAACAGCATTTCTGGACTTAAGAGG
ACTAAAGTCTGACGACACGGCCGTCTATTATTGCGTGAGAGATCGCAGTAATGGATCGGGAA
AGCGATTCGAGTCCTCCAATTGGTTCCTCGATCTGTGGGGCCGTGGGACTGCGGTCACAATTC
AATCATCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCT
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGA
ACCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA
SEQ ID NO: 166

LIGHT CHAIN

QSALTQPRSVSASPGQSVTISCTGTHNLVSWCQHQPGRAPKLLIYDFNKRPSGVPDRFSGSGSGGTASLT
ITGLQDDDDAEYFCWAYEAFGGGTKLTVLRQPKAAPSVTLFPPSSEELQANKATLVCLISDFYPGAV
TVAWKADSSPVKAGVETTTPSKQSNNKYAASSYLSLTPEQWKSHRSYSCQVTHEGSTVEKTVAPT
ECS
SEQ ID NO: 167

CAGTCTGCCCTGACTCAGCCTCGCTCAGTGTCCGCATCTCCTGGGCAGTCCGTCACCATTTCCT
GCACTGGAACCCACAATTTGGTCTCTTGGTGTCAACATCAGCCAGGCAGAGCCCCCAAATTAT
TAATTTATGACTTCAATAAGAGGCCCTCAGGGGTCCCTGATCGCTTCTCTGGCTCCGGGTCTGG
CGGCACGGCCTCCCTGACCATCACTGGACTCCAGGATGACGATGACGCCGAATATTTTGTTG
GGCGTATGAAGCTTTTGGCGGAGGGACCAAGTTGACCGTTCTTCGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 168

>N49P7A
HEAVY CHAIN

ADLQSGAVVKKPGDSVRISCEAQGYRFPDYIIHWIRRAVPGQGPEWMGWMNPMGGQVNIPWKFQGR
VSMTRDTSIETAFLDLRGLKSDDTAVYYCVRDRSNGSGKRFESSNWFLDLWGRGTAVTIQSASYKGPS
VFPLAPSSKSTSGGTAALGCLVKDYFPEPVTVSWNSGALTSGVHTFPAVLQSSGLYSLSSVVTVPSS
SLGTQTYICNVNHKPSNTKVDKRVEPKSCDKTHTCPPCPAPELLGGPSVFLPPPKPKDTLMISRTPE
VTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK
SEQ ID NO: 169

GCGGACTTGGTGCAGTCTGGGGCTGTGGTGAAGAAGCCTGGGGACTCAGTGAGGATCTCCTGT
GAGGCTCAAGGATATAGATTTCCTGACTACATCATTCACTGGATTCGACGGGCCCCTGGACAA
GGCCCTGAATGGATGGGATGGATGAATCCAATGGGCGGACAAGTAAATATTCCATGGAAATT
TCAGGGTAGGGTCTCCATGACCCGGGACACGTCCATCGAAACAGCATTTCTGGACTTAAGAGG
ACTAAAGTCTGACGACACGGCCGTCTATTATTGCGTGAGAGATCGCAGTAATGGATCGGGAA
AGCGATTCGAGTCCTCCAATTGGTTCCTCGATCTGTGGGGCCGTGGGACTGCGGTCACAATTC

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

```
AATCAGCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCGT
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGTTGAGCCCAAATCTTGT
GACAAAACTCACACATGCCCACCGTGCCCAGCACCTGAACTCCTGGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGA
ACCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA
SEQ ID NO: 170

LIGHT CHAIN

QSALTQPRSVSASPGQSVTISCTGTHNLVSWAQHQPGRAPKLLIYDFNKRPSGVPDRFSGSGSGGTASLT
ITGLQDDDDAEYFCWAYEAFGGGTKLTVLGQPKAAPSVTLFPPSSEELQANKATLVCLISDFYPGAV
TVAWKADSSPVKAGVETTTPSKQSNNKYAASSYLSLTPEQWKSHRSYSCQVTHEGSTVEKTVAPT
ECS
SEQ ID NO: 171

CAGTCTGCCCTGACTCAGCCTCGCTCAGTGTCCGCATCTCCTGGGCAGTCCGTCACCATTTCCT
GCACTGGAACCCACAATTTGGTCTCTTGGGCTCAACATCAGCCAGGCAGAGCCCCCAAATTAT
TAATTTATGACTTCAATAAGAGGCCCTCAGGGGTCCCTGATCGCTTCTCTGGCTCCGGGTCTGG
CGGCACGGCCTCCCTGACCATCACTGGACTCCAGGATGACGCAGCCGAATATTTTTGTTG
GGCGTATGAAGCTTTTGGCGGAGGGACCAAGTTGACCGTTCTTGGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACTATGCGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 172

>N49P7F
HEAVY CHAIN

ADLQSGAVVKKPGDSVRISCEAQGYRFPDYIIHWIRRAVPGQGPEWMGWMNPMGGQVNIPWKFQGR
VSMTRDTSIETAFLDLRGLKSDDTAVYYCVRDRSNGSGKRFESSNWFLDLWGRGTAVTIQSASYKGPS
VFPPLAPSSKSTSGGTAALGCLVKDYFPEPVTVSWNSGALTSGVHTFPAVLQSSGLYSLSSVVTVPSS
SLGTQTYICNVNHKPSNTKVDKRVEPKSCDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK
SEQ ID NO: 173

GCGGACTTGGTGCAGTCTGGGGCTGTGGTGAAGAAGCCTGGGGACTCAGTGAGGATCTCCTGT
GAGGCTCAAGGATATAGATTTCCTGACTACATCATTCACTGGATTCGACGGGCCCCTGGACAA
GGCCCTGAATGGATGGATGGATGAATCCAATGGGCGGACAAGTAAATATTCCATGGAAATT
TCAGGGTAGGGTCTCCATGACCCGGGACACGTCCATCGAAACAGCATTTCTGGACTTAAGAGG
ACTAAAGTCTGACGACACGGCCGTCTATTATTGCGTGAGAGATCGCAGTAATGGATCGGAA
AGCGATTCGAGTCCTCCAATTGTTCCTCGATCTGTGGGCGTGGAGCTGCGGTCACAATTC
AATCAGCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCGT
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGTTGAGCCCAAATCTTGT
GACAAAACTCACACATGCCCACCGTGCCCAGCACCTGAACTCCTGGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGA
```

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

```
ACCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA
SEQ ID NO: 174
```

LIGHT CHAIN

*QSALTQPRSVSASPGQSVTISCTGT*HNL*VSWF*Q*HQPGRAPKLLIY*DFN*KRPSGVPDRFSGSGSGGTASLT ITGLQDDDDAEYFC*WAYEA*FGGGTKLTVLGQ*P*KAAPSVTLFPPSSEELQANKATLVCLISDFYPGAV TVAWKADSSPVKAGVETTTPSKQSNNKYA*A*SSYLSLTPEQWKSHRSYSCQVTHEGSTVEKTVAPT ECS
SEQ ID NO: 175

```
CAGTCTGCCCTGACTCAGCCTCGCTCAGTGTCCGCATCTCCTGGGCAGTCCGTCACCATTTCCT
GCACTGGAACCCACAATTTGTCTCTTGGTTTCAACATCAGCCAGGCAGAGCCCCCAAATTAT
TAATTTATGACTTCAATAAGAGGCCCTCAGGGGTCCCTGATCGCTTCTCTGGCTCCGGGTCTGG
CGGCACGGCCTCCCTGACCATCACTGGACTCCAGGATGACGATGACGCCGAATATTTTGTTG
GGCGTATGAAGCTTTTGGCGGAGGGACCAAGTTGACCGTTCTTGGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 176
```

>N49P7S
HEAVY CHAIN

*ADLQSGAVVKKPGDSVRISCEAQ*GYRFPDYI* IHWIRRAVPGQGPEWMGW*MNPMGGQVNIPWKFQGR VSMTRDTSIETAFLDLRGLKSDDTAVYYC*VRDRSNGSGKRFESSNWFLDL***WGRGTAVTIQS*ASYKGPS VFPPLAPSSKSTSGGTAALGCLVKDYFPEPVTVSWNSGALTSGVHTFPAVLQSSGLYSLSSV*V*TVPSS SLGTQTYICNVNHKPSNTKVDK*R*VEPKSCDKTHTCPPCPAPELLGGPSVFLFPPKPKDTLM*I*SRTPE VTCVVVDVSHEDPEVKFNWYVDGVEVHNAKTKPREEQYNSTYRVVSVLTVLHQDWLNGKEYK CKVSNKALPAPIEKTISKAKGQPREPQVYTLPPSREEMTKNQVSLTCLVKGFYPSDIAVEWESNGQ PENNYKTTPPVLDSDGSFFLYSKLTVDKSRWQQGNV*F*SCSVMHEALHNHYTQKSLSLSPGK
SEQ ID NO: 177

```
GCGGACTTGGTGCAGTCTGGGGCTGTGGTGAAGAAGCCTGGGGACTCAGTGAGGATCTCCTGT
GAGGCTCAAGGATATAGATTTCCTGACTACATCATTCACTGGATTCGACGGGCCCCTGGACAA
GGCCCTGAATGGATGGGATGGATGAATCCAATGGGCGGACAAGTAAATATTCCATGGAAATT
TCAGGGTAGGGTCTCCATGACCCGGGACACGTCCATCGAAACAGCATTTCTGGACTTAAGAGG
ACTAAAGTCTGACGACACGGCCGTCTATTATTGCGTGAGAGATCGCAGTAATGGATCGGGAA
AGCGATTCGAGTCCTCCAATTGTTCCTCGATCTGTGGGCCGTGGGACTGCGGTCACAATTC
AATCAGCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCGAACCGGTGACGGTGTCGT
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGA
ACCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA
SEQ ID NO: 178
```

LIGHT CHAIN

*QSALTQPRSVSASPGQSVTISCTGT*HNL*VSWS*Q*HQPGRAPKLLIY*DFN*KRPSGVPDRFSGSGSGGTASLTI TGLQDDDDAEYFC*WAYEA*FGGGTKLTVLGQ*P*KAAPSVTLFPPSSEELQANKATLVCLISDFYPGAVT

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

VAWKADSSPVKAGVETTTPSKQSNNKYAASSYLSLTPEQWKSHRSYSCQVTHEGSTVEKTVAPTE
CS
SEQ ID NO: 179

CAGTCTGCCCTGACTCAGCCTCGCTCAGTGTCCGCATCTCCTGGGCAGTCCGTCACCATTTCCT
GCACTGGAACCCACAATTTGGTCTCTTGGTCTCAACATCAGCCAGGCAGAGCCCCCAAATTAT
TAATTTATGACTTCAATAAGAGGCCCTCAGGGGTCCCTGATCGCTTCTCTGGCTCCGGGTCTGG
CGGCACGGCCTCCCTGACCATCACTGGACTCCAGGATGACGATGACGCCGAATATTTTTGTTG
GGCGTATGAAGCTTTTGGCGGAGGGACCAAGTTGACCGTTCTTGGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 180

>N49P7Y
HEAVY CHAIN

*ADLQSGAVVKKPGDSVRISCEAQ*GYRFPDYI*IHWIRRAVPGQGPEWMGW*MNPMGGQV*NIPWKFQGR*
*VSMTRDTSIETAFLDLRGLKSDDTAVYYC*VRDRSNGSGKRFESSNWFLDL*WGRGTAVTIQ*SA*SYKGPS*
VFPLAPSSKSTSGGTAALGCLVKDYFPEPVTVSWNSGALTSGVHTFPAVLQSSGLYSLSSVVTVPSS
SLGTQTYICNVNHKPSNTKVDKRVEPKSCDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK
SEQ ID NO: 181

GCGGACTTGGTGCAGTCTGGGGCTGTGGTGAAGAAGCCTGGGGACTCAGTGAGGATCTCCTGT
GAGGCTCAAGGATATAGATTTCCTGACTACATCATTCACTGGATTCGACGGGCCCCTGGACAA
GGCCCTGAATGGATGGGATGGATGAATCCAATGGGCGGACAAGTAAATATTCCATGGAAATT
TCAGGGTAGGGTCTCCATGACCCGGGACACGTCCATCGAAACAGCATTTCTGGACTTAAGAGG
ACTAAAGTCTGACGACACGGCCGTCTATTATTGCGTGAGAGATCGCAGTAATGGATCGGAA
AGCGATTCGAGTCCTCCAATTGTTCCTCGATCTGTGGGGCCGTGGGACTGCGGTCACAATTC
AATCAGCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCGT
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGA
ACCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA
SEQ ID NO: 182

LIGHT CHAIN

*QSALTQPRSVSASPGQSVTISCTGT*SHNLVSWYQHQPGRAPKLLIYDFNKRPSGVPDRFSGSGSGGTASLTI*
*TGLQDDDDAEYFC*WAYEA*FGGGTKLTVLGQP*KAAPSVTLFPPSSEELQANKATLVCLISDFYPGAVT
VAWKADSSPVKAGVETTTPSKQSNNKYAASSYLSLTPEQWKSHRSYSCQVTHEGSTVEKTVAPTE
CS
SEQ ID NO: 183

CAGTCTGCCCTGACTCAGCCTCGCTCAGTGTCCGCATCTCCTGGGCAGTCCGTCACCATTTCCT
GCACTGGAACCCACAATTTGGTCTCTTGGTATCAACATCAGCCAGGCAGAGCCCCCAAATTAT
TAATTTATGACTTCAATAAGAGGCCCTCAGGGGTCCCTGATCGCTTCTCTGGCTCCGGGTCTGG
CGGCACGGCCTCCCTGACCATCACTGGACTCCAGGATGACGATGACGCCGAATATTTTTGTTG
GGCGTATGAAGCTTTTGGCGGAGGGACCAAGTTGACCGTTCTTGGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

```
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 184
```

>N49P7-54TY
HEAVY CHAIN

*ADLVQSGAVVKKPGDSVRISCEAQ**GYRFPDYIIHWIRRAPGQGPEWMGWMNPTYGQV**NIPWKFQGRV*
*SMTRDTSIETAFLDLRGLKSDDTAVYYC**VRDRSNGSGKRFESSNWFLDL**WGRGTAVTIQS*ASTKGPSV
FPLAPSSKSTSGGTAALGCLVKDYFPEPVTVSWNSGALTSGVHTFPAVLQSSGLYSLSSVVTV̲PSSS
LGTQTYICNVNHKPSNTKVDKRVEPKSCDKTHTCPPCPAPELLGGPSVFLFPPKPKDTLMISRTPEV
TCVVVDVSHEDPEVKFNWYVDG̲VEVHNAKTKPREEQYNSTYRVVSVLTVLHQDWLNGKEYKC
KVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNV̲F̲S̲CSVMHEALHNHYTQKSLSLSPGK
SEQ ID NO: 185

```
GCGGACTTGGTGCAGTCTGGGGCTGTGGTGAAGAAGCCTGGGGACTCAGTGAGGATCTCCTGT
GAGGCTCAAGGATATAGATTTCCTGACTACATCATTCACTGGATTCGACGGGCCCCTGGACAA
GGCCCTGAATGGATGGGATGGATGAATCCAACGTACGGACAAGTAAATATTCCATGGAAATT
TCAGGGTAGGGTCTCCATGACCCGGGACACGTCCATCGAAACAGCATTTCTGGACTTAAGAGG
ACTAAAGTCTGACGACACGGCCGTCTATTATTGCGTGAGAGATCGCAGTAATGGATCGGGAA
AGCGATTCGAGTCCTCCAATTGGTTCCTCGATCTGTGGGGCCGTGGGACTGCGGTCACAATTC
AATCAGCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCGT
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGA
ACCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA
SEQ ID NO: 186
```

LIGHT CHAIN

*QSALTQPRSVSASPGQSVTISCTGT**HNLVSWCQHQPGRAPKLLIYDFN**KRPSGVPDRFSGSGSGGTASLT*
*ITGLQDDDDAEYFC**WAYEA**FGGGTKLTVLGQPKAAPSVTLFPPSSEELQANKATLVCLISDFYPGAV*
TVAWKADSSPVKAGVETTTPSKQSNNKYAA̲SSYLSLTPEQWKSHRSYSCQVTHEGSTVEKTVAPT
ECS
SEQ ID NO: 187

```
CAGTCTGCCCTGACTCAGCCTCGCTCAGTGTCCGCATCTCCTGGGCAGTCCGTCACCATTTCCT
GCACTGGAACCCACAATTTGGTCTCTTGGTGTCAACATCAGCCAGGCAGAGCCCCCAAATTAT
TAATTTATGACTTCAATAAGAGGCCCTCAGGGGTCCCTGATCGCTTCTCTGGCTCCGGGTCTGG
CGGCACGGCCTCCCTGACCATCACTGGACTCCAGGATGACGATGACGCCGAATATTTTTGTTG
GGCGTATGAAGCTTTTGGCGGAGGGACCAAGTTGACCGTTCTTGGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 188
```

>N49P7LS-1
HEAVY CHAIN

*ADLVQSGAVVKKPGDSVRISCEAQ**GYRFPDYIIHWIRRAPGQGPEWMGWMNPMGGQV**NIPWKFQGR*
*VSMTRDTSIETAFLDLRGLKSDDTAVYYC**VRDRSNGSGKRFESSNWFLDL**WGRGTAVTIQS*ASTKGPS
VFPLAPSSKSTSGGTAALGCLVKDYFPEPVTVSWNSGALTSGVHTFPAVLQSSGLYSLSSVVTV̲PSS
SLGTQTYICNVNHKPSNTKVDKRVEPKSCDKTHTCPPCPAPELLGGPSVFLFPPKPKDTLMISRTPE
VTCVVVDVSHEDPEVKFNWYVDG̲VEVHNAKTKPREEQYNSTYRVVSVLTVLHQDWLNGKEYK

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

CKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVLHEALHSHYTQKSLSLSPGK
SEQ ID NO: 189

GCGGACTTGGTGCAGTCTGGGGCTGTGGTGAAGAAGCCTGGGGACTCAGTGAGGATCTCCTGT
GAGGCTCAAGGATATAGATTTCCTGACTACATCATTCACTGGATTCGACGGGCCCCTGGACAA
GGCCCTGAATGGATGGGATGGATGAATCCAATGGGCGGACAAGTAAATATTCCATGGAAATT
TCAGGGTAGGGTCTCCATGACCCGGGACACGTCCATCGAAACAGCATTTCTGGACTTAAGAGG
ACTAAAGTCTGACGACACGGCCGTCTATTATTGCGTGAGAGATCGCAGTAATGGATCGGGAA
AGCGATTCGAGTCCTCCAATTGGTTCCTCGATCTGTGGGGCCGTGGGACTGCGGTCACAATTC
AATCAGCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCGT
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGA
ACCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGCT
GCATGAGGCTCTGCACAGCCACTACACGCAGAAGAGCCTCTCCCTGTCCCCGGGTAAA
SEQ ID NO: 190

LIGHT CHAIN

QSALTQPRSVSASPGQSVTISCTGTHNLVSWCQHQPGRAPKLLIYDFNKRPSGVPDRFSGSGSGGTASLT
ITGLQDDDDAEYFCWAYEAFGGGTKLTVLGQPKAAPSVTLFPPSSEELQANKATLVCLISDFYPGAV
TVAWKADSSPVKAGVETTTPSKQSNNKYAASSYLSLTPEQWKSHRSYSCQVTHEGSTVEKTVAPT
ECS
SEQ ID NO: 191

CAGTCTGCCCTGACTCAGCCTCGCTCAGTGTCCGCATCTCCTGGGCAGTCCGTCACCATTTCCT
GCACTGGAACCCACAATTTGGTCTCTTGGTGTCAACATCAGCAGGCAGAGAGCCCCAAATTAT
TAATTTATGACTTCAATAAGAGGCCCTCAGGGGTCCCTGATCGCTTCTCTGGCTCCGGGTCTGG
CGGCACGGCCTCCCTGACCATCACTGGACTCCAGGATGACGATGACGCCGAATATTTTGTTG
GGCGTATGAAGCTTTTGGCGGAGGGACCAAGTTGACCGTTCTTGGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 192

>N49P7LS-2
HEAVY CHAIN

ADLVQSGAVVKKPGDSVRISCEAQGYRFPDYIIHWIRRAPGQGPEWMGWMNPMGGQVNIPWKFQGR
VSMTRDTSIETAFLDLRGLKSDDTAVYYCVRDRSNGSGKRFESSNWFLDLWGRGTAVTIQSASTKGPS
VFPLAPSSKSTSGGTAALGCLVKDYFPEPVTVSWNSGALTSGVHTFPAVLQSSGLYSLSSVVTVPSS
SLGTQTYICNVNHKPSNTKVDKRVEPKSCDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQP
ENNYKTTPPVLDSDGSFFLYSKLTVDKSRWQQGNVFSCSVLHEALHSHYTQKSLSLSPGK
SEQ ID NO: 193

GCGGACTTGGTGCAGTCTGGGGCTGTGGTGAAGAAGCCTGGGGACTCAGTGAGGATCTCCTGT
GAGGCTCAAGGATATAGATTTCCTGACTACATCATTCACTGGATTCGACGGGCCCCTGGACAA
GGCCCTGAATGGATGGGATGGATGAATCCAATGGGCGGACAAGTAAATATTCCATGGAAATT
TCAGGGTAGGGTCTCCATGACCCGGGACACGTCCATCGAAACAGCATTTCTGGACTTAAGAGG
ACTAAAGTCTGACGACACGGCCGTCTATTATTGCGTGAGAGATCGCAGTAATGGATCGGGAA
AGCGATTCGAGTCCTCCAATTGGTTCCTCGATCTGTGGGGCCGTGGGACTGCGGTCACAATTC
AATCAGCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCGT

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV antibodies are shown below. Variable regions within the heavy and
light chain in the amino acid sequence are italicized and changes
to the amino acid sequence relative to a natural antibody
sequence are underlined. CDR residues are in bold.

```
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGA
ACCACAGGTGTACACCCTGCCCCCATCCCGGGATGAGCTGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGCT
GCATGAGGCTCTGCACAGCCACTACACGCAGAAGAGCCTCTCCCTGTCCCCGGGTAAA
SEQ ID NO: 194
```

LIGHT CHAIN

*QSALTQPRSVSASPGQSVTISCTGTHNLVSWCQHQPGRAPKLLIYDFNKRPSGVPDRFSGSGSGGTASLT
ITGLQDDDDAEYFCWAYEAFGGGTKLTVLG*QPKAAPSVTLFPPSSEELQANKATLVCLISDFYPGAV
TVAWKADSSPVKAGVETTTPSKQSNNKYAA̲SSYLSLTPEQWKSHRSYSCQVTHEGSTVEKTVAPT
ECS
SEQ ID NO: 195

```
CAGTCTGCCCTGACTCAGCCTCGCTCAGTGTCCGCATCTCCTGGGCAGTCCGTCACCATTTCCT
GCACTGGAACCCACAATTTGGTCTCTTGGTGTCAACATCAGCCAGGCAGAGCCCCCAAATTAT
TAATTTATGACTTCAATAAGAGGCCCTCAGGGGTCCCTGATCGCTTCTCTGGCTCCGGGTCTGG
CGGCACGGCCTCCCTGACCATCACTGGACTCCAGGATGACGATGACGCCGAATATTTTTGTTG
GGCGTATGAAGCTTTTGGCGGAGGGACCAAGTTGACCGTTCTTGGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 196
```

>N49P7YTE
HEAVY CHAIN

*ADLVQSGAVVKKPGDSVRISCEAQGYRFPDYIIHWIRRAPGQGPEWMGWMNPMGGQVNIPWKFQGR
VSMTRDTSIETAFLDLRGLKSDDTAVYYCVRDRSNGSGKRFESSNWFLDLWGRGTAVTIQSASTKGPS*
VFPLAPSSKSTSGGTAALGCLVKDYFPEPVTVSWNSGALTSGVHTFPAVLQSSGLYSLSSVV̲TVPSS
SLGTQTYICNVNHKPSNTKVDKRVEPKSCDKTHTCPPCPAPELLGGPSVFLFPPKPKDTLYITREPE
VTCVVVDVSHEDPEVKFNWYVDG̲VEVHNAKTKPREEQYNSTYRVVSVLTVLHQDWLNGKEYK̲ ̲
CKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNV̲FS̲CSVMHEALHNHYTQKSLSLSPGK
SEQ ID NO: 197

```
GCGGACTTGGTGCAGTCTGGGGCTGTGGTGAAGAAGCCTGGGGACTCAGTGAGGATCTCCTGT
GAGGCTCAAGGATATAGATTTCCTGACTACATCATTCACTGGATTCGACGGGCCCCTGGACAA
GGCCCTGAATGGATGGGATGGATGAATCCAATGGGCGGACAAGTAAATATTCCATGGAAATT
TCAGGGTAGGGTCTCCATGACCCGGGACACGTCCATCGAAACAGCATTTCTGGACTTAAGAGG
ACTAAAGTCTGACGACACGGCCGTCTATTATTGCGTGAGAGATCGCAGTAATGGATCGGGAA
AGCGATTCGAGTCCTCCAATTGGTTCCTCGATCTGTGGGGCCGTGGGACTGCGGTCACAATTC
AATCAGCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCGT
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGGACCGTCAGTCTTC
CTCTTCCCCCCAAAACCCAAGGACACCCTCTATATCACCCGGGAGCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGA
ACCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
```

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

```
AGCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA
SEQ ID NO: 198
```

LIGHT CHAIN

*QSALTQPRSVSASPGQSVTISCTGTHNLVSWCQHQPGRAPKLLIYDFNKRPSGVPDRFSGSGSGGTASLT ITGLQDDDDAEYFCWAYEAFGGGTKLTVLGQPKAAPSVTLFPPSSEELQANKATLVCLISDFYPGAV TVAWKADSSPVKAGVETTTPSKQSNNKYAASSYLSLTPEQWKSHRSYSCQVTHEGSTVEKTVAPT ECS*
SEQ ID NO: 199

```
CAGTCTGCCCTGACTCAGCCTCGCTCAGTGTCCGCATCTCCTGGGCAGTCCGTCACCATTTCCT
GCACTGGAACCCACAATTTGGTCTCTTGGTGTCAACATCAGCCAGGCAGAGCCCCCAAATTAT
TAATTTATGACTTCAATAAGAGGCCCTCAGGGGTCCCTGATCGCTTCTCTGGCTCCGGGTCTGG
CGGCACGGCCTCCCTGACCATCACTGGACTCCAGGATGACGATGACGCCGAATATTTTTGTTG
GGCGTATGAAGCTTTTGGCGGAGGGACCAAGTTGACCGTTCTTGGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 200
```

>N49P7L6
HEAVY CHAIN

*ADLVQSGAVVKKPGDSVRISCEAQGYRFPDYIIHWIRRAPGQGPEWMGWMNPMGGQVNIPWKFQGR VSMTRDTSIETAFLDLRGLKSDDTAVYYCVRDRSNGSGKRFESSNWFLDLWGRGTAVTIQSASTKGPS* VFPLAPSSKSTSGGTAALGCLVKDYFPEPVTVSWNSGALTSGVHTFPAVLQSSGLYSLSSVVTVPSS SLGTQTYICNVNHKPSNTKVDKRVEPKSCDKTHTCPPCPAPELLGGPSVFLFPPKPKDTLMISRTPE VTCVVVDVSHEDPEVKFNWYVDGVEVHNAKTKPREEQYNSTYRVVSVLTVLHQDWLNGKEYK CKVSNKALPAPIEKTISKAKGQPREPQVYTLPPSREEMTKNQVSLTCLVKGFYPSDIAVEWESNGQ PENNYKTTPPVLDSDGSFFLYSKLTVDKSRWQQGNVFSCSVMHEALHNHYTQKSLSLSPGK
SEQ ID NO: 201

```
GCGGACTTGGTGCAGTCTGGGGCTGTGGTGAAGAAGCCTGGGGACTCAGTGAGGATCTCCTGT
GAGGCTCAAGGATATAGATTTCCTGACTACATCATTCACTGGATTCGACGGGCCCCTGGACAA
GGCCCTGAATGGATGGGATGGATGAATCCAATGGGCGGACAAGTAAATATTCCATGGAAATT
TCAGGGTAGGGTCTCCATGACCCGGGACACGTCCATCGAAACAGCATTTCTGGACTTAAGAGG
ACTAAAGTCTGACGACACGGCCGTCTATTATTGCGTGAGAGATCGCAGTAATGGATCGGGAA
AGCGATTCGAGTCCTCCAATTGTTCCTCGATCTGTGGGGCCGTGGGACTGCGGTCACAATTC
AATCAGCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCGT
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGA
ACCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA
SEQ ID NO: 202
```

LIGHT CHAIN

*QSALTQPRSVSASPGQSVTISCTGTHNYVSWCQQKPGQAPKLLIYDFNKRPSGVSDRFSGSTSGNTASLTI SGLQADDEGHYFCWAFENIGGGTKLTVLGQPKAAPSVTLFPPSSEELQANKATLVCLVSDFYPGAV TVAWKADGSPVKVGVETTKPSKQSNNKYAASSYLSLTPEQWKSHRSYSCRVTHEGSTVEKTVAP AECS*
SEQ ID NO: 203

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

```
CAGTCTGCCCTAACTCAGCCTCGCTCAGTGTCCGCATCTCCTGGTCAGTCAGTCACCATCTCCT
GCACTGGAACACACAATTATGTGTCCTGGTGTCAACAGAAACCGGGCCAAGCCCCCAAATTAT
TAATTTACGATTTCAATAAACGGCCCTCAGGGGTCTCTGATCGCTTCTCTGGCTCCACGTCTGG
CAACACGGCCTCCCTGACCATCTCTGGACTCCAGGCTGACGATGAGGGTCATTATTTTTGTTG
GGCGTTTGAAAATATCGGCGGAGGGACCAAGCTGACCGTCCTGGGTCAGCCCAAGGCTGCCC
CCTCGGTCACTCTGTTCCCACCCTCCTCTGAGGAGCTTCAAGCCAACAAGGCCACACTGGTGT
GTCTCGTAAGTGACTTCTACCCGGGAGCCGTGACAGTGGCCTGGAAGGCAGATGGCAGCCCC
GTCAAGGTGGGAGTGGAGACCACCAAACCCTCCAAACAAAGCAACAACAAGTATGCGGCCAG
CAGCTACCTGAGCCTGACGCCCGAGCAGTGGAAGTCCCACAGAAGCTACAGCTGCCGGGTCA
CGCATGAAGGGAGCACCGTGGAGAAGACAGTGGCCCCTGCAGAATGCTCT
SEQ ID NO: 204

>N49P7L11
HEAVY CHAIN
```

*ADLVQSGAVVKKPGDSVRISCEAQ*GYRFPDYI *IHWIRRAPGQGPEWMGW*MNPMGGQV *NIPWKFQGR*
*VSMTRDTSIETAFLDLRGLKSDDTAVYYC*VRDRSNGSGKRFESSNWFLDL*WGRGTAVTIQSASTKGPS*
VFPLAPSSKSTSGGTAALGCLVKDYFPEPVTVSWNSGALTSGVHTFPAVLQSSGLYSLSSVV̲TVPSS
SLGTQTYICNVNHKPSNTKVDKRVEPKSCDKTHTCPPCPAPELLGGPSVFLFPPKPKDTLMISRTPE
VTCVVVDVSHEDPEVKFNWYVDG̲VEVHNAKTKPREEQYNSTYRVVSVLTVLHQDWLNGKEYK
CKVSNKALPAPIEKTISKAKGQPREPQVYTLPPSRE̲E̲MTKNQVSLTCLVKGFYPSDIAVEWESNGQ
PENNYKTTPPVLDSDGSFFLYSKLTVDKSRWQQGNV̲FSCSVMHEALHNHYTQKSLSLSPGK
SEQ ID NO: 205

```
GCGGACTTGGTGCAGTCTGGGGCTGTGGTGAAGAAGCCTGGGGACTCAGTGAGGATCTCCTGT
GAGGCTCAAGGATATAGATTTCCTGACTACATCATTCACTGGATTCGACGGGCCCCTGGACAA
GGCCCTGAATGGATGGGATGGATGAATCCAATGGGCGGACAAGTAAATATTCCATGGAAATT
TCAGGGTAGGGTCTCCATGACCCGGGACACGTCCATCGAAACAGCATTTCTGGACTTAAGAGG
ACTAAAGTCTGACGACACGGCCGTCTATTATTGCGTGAGAGATCGCAGTAATGGATCGGGAA
AGCGATTCGAGTCCTCCAATTGTTCCTCGATCTGTGGGGCCGTGGGACTGCGGTCACAATTC
AATCAGCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCGT
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGA
ACCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA
SEQ ID NO: 206

LIGHT CHAIN
```

*QCVLTQPRSVSGSPGQSVTISCTGT*HNY *VSWCQHHPGNAPKLLLY*DFD*KRPSGISDRFSGSRSGNTASLT*
*ISGLQPEDEADYFC*WAFEA *FGGGTKVLVLRQPKAAPSVTLFPPSSEELQANKATLVCLISDFYPGAV*
TVAWKADSSPVKAGVETTTPSKQSNNKYAASSYLSLTPEQWKSHRSYSCQVTHEGSTVEKTVAPT
ECS
SEQ ID NO: 207

```
CAGTGTGTCTTGACTCAGCCTCGCTCAGTGTCCGGATCTCCTGGACAATCAGTCACCATCTCCT
GCACTGGAACTCACAATTATGTCTCCTGGTGTCAACACCACCCAGGCAACGCCCCCAAATTAT
TACTTTATGATTTCGACAAGCGGCCCTCAGGAATCTCTGATCGCTTCTCTGGCTCTAGGTCTGG
CAACACGGCCTCCCTGACCATCTCTGGCCTCCAGCCTGAGGATGAGGCCGATTACTTTTGTTG
GGCCTTTGAAGCCTTTGGCGGAGGGACCAAGGTGCTCGTCCTTCGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
```

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 208

>N49P7.1L9
HEAVY CHAIN

*ADLVQSGAVVKKPGDSVRISCEAQ*GYRFPDYI *IHWIRRAPGQGPEWMGW*MNPMGGQV *NIPWKFQGR*
*VSMTRDTSIETAFLDLRGLKSDDTAVYYC*VRDRSNGSGKRFESSNWFLDL*WGRGTAVTIQSS*STKGPS
VFPLAPSSKSTSGGTAALGCLVKDYFPEPVTVSWNSGALTSGVHTFPAVLQSSGLYSLSSVV̄TVPSS
SLGTQTYICNVNHKPSNTKVDKRVEPKSCDKTHTCPPCPAPELLGGPSVFLFPPKPKDTLMISRTPE
VTCVVVDVSHEDPEVKFNWYVDḠVEVHNAKTKPREEQYNSTYRVVSVLTVLHQDWLNGKEYK
CKVSNKALPAPIEKTISKAKGQPREPQVYTLPPSR̄EEMTKNQVSLTCLVKGFYPSDIAVEWESNGQ
PENNYKTTPPVLDSDGSFFLYSKLTVDKSRWQQGN̄V̄FSCSVMHEALHNHYTQKSLSLSPGK
SEQ ID NO: 209

GCGGACTTGGTGCAGTCTGGGGCTGTGGTGAAGAAGCCTGGGGACTCAGTGAGGATCTCCTGT
GAGGCTCAAGGATATAGATTTCCTGACTACATCATTCACTGGATTCGACGGGCCCCTGGACAA
GGCCCTGAATGGATGGGATGGATGAATCCAATGGGCGGACAAGTAAATATTCCATGGAAATT
TCAGGGTAGGGTCTCCATGACCCGGGACACGTCCATCGAAACAGCATTTCTGGACTTAAGAGG
ACTAAAGTCTGACGACACGGCCGTCTATTATTGCGTGAGAGATCGCAGTAATGGATCGGAA
AGCGATTCGAGTCCTCCAATTGTTCCTCGATCTGTGGGGCCGTGGGACTGCGGTCACAATTC
AATCATCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCGT
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGA
ACCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA
SEQ ID NO: 210

LIGHT CHAIN

*ASALTQPASMSASPGQSVTISCSGT*RHII*SAWFQQYPGKPPKLIIF*DDD*KRPSGVPSRFSASRPGDTASLTI*
*SNVQPEDEATYIC*NTYEF*FGGGTRLTVLSQPKAAPSVTLFPPSSEELQANKATLVCLVSDFYPGAVTV
AWKADGSPVKVGVETTKPSKQSNNKYAASSYLSLTPEQWKSHRSYSCRVTHEGSTVEKTVAPAE
CS
SEQ ID NO: 211

GCATCTGCCCTGACTCAGCCTGCCTCCATGTCTGCGTCCCCTGGACAGTCGGTAACCATCTCGT
GCTCTGGAACCAGACACATAATCTCTGCTTGGTTCCAACAATATCCAGGCAAACCACCCAAAC
TCATAATTTTTGACGACGATAAGCGTCCCTCTGGAGTTCCTGATCGCTTCTCTGCCTCCAGGCC
TGGCGACACGGCCTCCCTGACAATCTCTAATGTTCAACCTGAGGACGAGGCGACGTACATTTG
CAATACATATGAATTCTTTGGCGGAGGGACCAGATTGACCGTCCTAAGTCAGCCCAAGGCTGC
CCCCTCGGTCACTCTGTTCCCACCCTCCTCTGAGGAGCTTCAAGCCAACAAGGCCACACTGGT
GTGTCTCGTAAGTGACTTCTACCCGGGAGCCGTGACAGTGGCCTGGAAGGCAGATGGCAGCC
CCGTCAAGGTGGGAGTGGAGACCACCAAACCCTCCAAACAAAGCAACAACAAGTATGCGGCC
AGCAGCTACCTGAGCCTGACGCCCGAGCAGTGGAAGTCCCACAGAAGCTACAGCTGCCGGGT
CACGCATGAAGGGAGCACCGTGGAGAAGACAGTGGCCCCTGCAGAATGCTCT
SEQ ID NO: 212

>N49P7.1L19
HEAVY CHAIN

*ADLVQSGAVVKKPGDSVRISCEAQ*GYRFPDYI *IHWIRRAPGQGPEWMGW*MNPMGGQV *NIPWKFQGR*
*VSMTRDTSIETAFLDLRGLKSDDTAVYYC*VRDRSNGSGKRFESSNWFLDL*WGRGTAVTIQSS*STKGPS
VFPLAPSSKSTSGGTAALGCLVKDYFPEPVTVSWNSGALTSGVHTFPAVLQSSGLYSLSSVV̄TVPSS
SLGTQTYICNVNHKPSNTKVDKR̄VEPKSCDKTHTCPPCPAPELLGGPSVFLFPPKPKDTLMISRTPE

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.

Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

VTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK
SEQ ID NO: 213

GCGGACTTGGTGCAGTCTGGGGCTGTGGTGAAGAAGCCTGGGGACTCAGTGAGGATCTCCTGT
GAGGCTCAAGGATATAGATTTCCTGACTACATCATTCACTGGATTCGACGGGCCCCTGGACAA
GGCCCTGAATGGATGGGATGGATGAATCCAATGGGCGGACAAGTAAATATTCCATGGAAATT
TCAGGGTAGGGTCTCCATGACCCGGGACACGTCCATCGAAACAGCATTTCTGGACTTAAGAGG
ACTAAAGTCTGACGACACGGCCGTCTATTATTGCGTGAGAGATCGCAGTAATGGATCGGGAA
AGCGATTCGAGTCCTCCAATTGGTTCCTCGATCTGTGGGGCCGTGGGACTGCGGTCACAATTC
AATCATCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCGT
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGA
ACCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA
SEQ ID NO: 214

LIGHT CHAIN

QSALTQPRSVSATPGQSVTISCTGTHNYVSWCQQHPGRAPKLLIYDFNKRPSGVPDRFSGSGSGGTASLT
ITGLQDDDEADYFCWAYDAFGGGTKLTVLRQPKAAPSVTLFPPSSEELQANKATLVCLISDFYPGAV
TVAWKADSSPVKAGVETTTPSKQSNNKYAASSYLSLTPEQWKSHRSYSCQVTHEGSTVEKTVAPT
ECS
SEQ ID NO: 215

CAGTCTGCCCTGACTCAGCCTCGCTCAGTGTCCGCAACTCCTGGACAGTCAGTCACCATCTCCT
GCACTGGAACCCACAATTATGTCTCTTGGTGTCAACAACATCCAGGCAGAGCCCCCAAATTAC
TAATTTATGACTTCAATAAGAGGCCCTCAGGGGTCCCGGATCGCTTCTCTGGCTCCGGATCTG
GCGGCACGGCCTCCCTAACCATCACTGGACTCCAGGATGACGATGAAGCGGACTATTTTGTT
GGGCCTATGATGCTTTTGGCGGAGGGACCAAGTTGACCGTCCTGCGTCAGCCCAAGGCTGCCC
CCTCGGTCACTCTGTTCCCGCCCTCCTCTGAGGAGCTTCAAGCCAACAAGGCCACACTGGTGT
GTCTCATAAGTGACTTCTACCCGGGAGCCGTGACAGTGGCTTGGAAAGCAGATAGCAGCCCC
GTCAAGGCGGGAGTGGAGACCACCACACCCTCCAAACAAAGCAACAACAAGTACGCGGCCA
GCAGCTATCTGAGCCTGACGCCTGAGCAGTGGAAGTCCCACAGAAGCTACAGCTGCCAGGTC
ACGCATGAAGGGAGCACCGTGGAGAAGACAGTGGCCCCTACAGAATGTTCA
SEQ ID NO: 216

>R49P7
HEAVY CHAIN

ADLVQSGAVVKKPGDSVRISCEAQGYRFPDYIIHWIRRAPGQGPEWMGWMNPMGGQVNIPWKFQGR
VSMTRDTSIETAFLDLRGLKSDDTAVYYCVRDRSNGSGKRFESSNWFLDLWGRGTAVTIQSASTKGPS
VFPLAPSSRSTSESTAALGCLVKDYFPEPVTVSWNSGSLTSGVHTFPAVLQSSGLYSLSSVVTVPSS
SLGTQTYVCNVNHKPSNTKVDKRVEIKTCGGGSKPPTCPPCPAPELLGGPSVFLFPPKPKDTLMISR
TPEVTCVVVDVSQEDPDVKFNWYVNGAEVHHAQTKPRETQYNSTYRVVSVLTVTHQDWLNGKE
YTCKVSNKALPAPIQKTISKDKGQPREPQVYTLPPSREELTKNQVSLTCLVKGFYPSDIVVEWESSG
QPENTYKTTPPVLDSDGSYFLYSKLTVDKSRWQQGNVFSCSVLHEALHSHYTQKSLSLSPGK
SEQ ID NO: 217

GCGGACTTGGTGCAGTCTGGGGCTGTGGTGAAGAAGCCTGGGGACTCAGTGAGGATCTCCTGT
GAGGCTCAAGGATATAGATTTCCTGACTACATCATTCACTGGATTCGACGGGCCCCTGGACAA
GGCCCTGAATGGATGGGATGGATGAATCCAATGGGCGGACAAGTAAATATTCCATGGAAATT
TCAGGGTAGGGTCTCCATGACCCGGGACACGTCCATCGAAACAGCATTTCTGGACTTAAGAGG
ACTAAAGTCTGACGACACGGCCGTCTATTATTGCGTGAGAGATCGCAGTAATGGATCGGGAA
AGCGATTCGAGTCCTCCAATTGGTTCCTCGATCTGTGGGGCCGTGGGACTGCGGTCACAATTC

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

```
AATCAGCCTCGACCAAGGGCCCATCGGTCTTCCCCCTGGCGCCCTCCTCCAGGAGCACCTCCG
AGAGCACAGCGGCCCTGGGCTGCCTGGTCAAGGACTACTTCCCTGAACCCGTGACCGTGTCGT
GGAACTCAGGCTCCCTGACCAGCGGCGTGCACACCTTCCCGGCTGTCCTACAGTCCTCAGGGC
TCTACTCCCTCAGCAGCGTGGTGACCGTGCCCTCCAGCAGCTTGGGCACCCAGACCTACGTCT
GCAACGTAAACCACAAGCCCAGCAACACCAAGGTGGACAAGAGAGTTGAGATAAAAACATG
TGGTGGTGGCAGCAAACCTCCCACGTGCCCACCGTGCCCAGCACCTGAACTCCTGGGGGGACC
GTCAGTCTTCCTCTTCCCCCCAAAACCCAAGGACACCCTCATGATCTCCCGGACCCCTGAGGT
CACATGCGTGGTGGTAGACGTGAGCCAGGAAGACCCCGATGTCAAGTTCAACTGGTACGTAA
ATGGCGCGGAGGTGCATCATGCCCAGACGAAGCCACGGGAGACGCAGTACAACAGCACATAT
CGTGTGGTCAGCGTCCTCACCGTCACGCACCAGGACTGGCTGAACGGCAAGGAGTACACGTG
CAAGGTCTCCAACAAAGCCCTCCCGGCCCCATCCAGAAAACCATCTCCAAAGACAAAGGGC
AGCCCCGAGAGCCTCAGGTGTACACCCTGCCCCCGTCCCGGGAGGAGCTGACCAAGAACCAG
GTCAGCCTGACCTGCCTGGTCAAAGGCTTCTACCCCAGTGACATCGTCGTGGAGTGGGAGAGC
AGCGGGCAGCCGGAGAACACCTACAAGACCACCCCGCCCGTGCTGGACTCCGACGGCTCCTA
CTTCCTCTACAGCAAGCTCACCGTGGACAAGAGCAGGTGGCAGCAGGGGAACGTCTTCTCATG
CTCCGTGCTGCATGAGGCTCTGCACAGCCACTACACGCAGAAGAGCCTCTCCCTGTCCCCGGG
TAAA
SEQ ID NO: 218
```

LIGHT CHAIN

*QSALTQPRSVSASPGQSVTISCTGTHNLVSWCQHQPGRAPKLLIYDFNKRPSGVPDRFSGSGSGGTASLT
ITGLQDDDDAEYFCWAYEAFGGGTKLTVLG*QPKAAPSVTLFPPSSEELQANKATLVCLISDFYPGAV
EVAWKADG<u>SA</u>V<u>N</u>AGVETT<u>K</u>PSKQSNNKYAA<u>SS</u>YLSLT<u>SD</u>QWKSH<u>KS</u>YSCQVTHEGSTVEKTVAP
<u>AE</u>CS
SEQ ID NO: 219

```
CAGTCTGCCCTGACTCAGCCTCGCTCAGTGTCCGCATCTCCTGGGCAGTCCGTCACCATTTCCT
GCACTGGAACCCACAATTTGGTCTCTTGGTGTCAACATCAGCCAGGCAGAGCCCCCAAATTAT
TAATTTATGACTTCAATAAGAGGCCCTCAGGGGTCCCTGATCGCTTCTCTGGCTCCGGGTCTGG
CGGCACGGCCTCCCTGACCATCACTGGACTCCAGGATGACGATGACGCCGAATATTTTTGTTG
GGCGTATGAAGCTTTTGGCGGAGGGACCAAGTTGACCGTTCTTGGTCAGCCCAAGGCTGCCCC
CTCGGTCACTCTGTTCCCGCCCTCGAGCGAGGAGCTTCAAGCCAACAAGGCCACACTAGTGTG
TCTGATCAGTGACTTCTACCCGGGAGCCGTGGAAGTGGCCTGGAAGGCAGATGGCAGCGCTG
TCAACGCGGGAGTGGAGACCACCAAACCCTCCAAACAGAGCAACAACAAGTACGCGGCCAGC
AGCTACCTGAGCCTGACGTCCGACCAGTGGAAGTCCCACAAGAGCTACAGCTGCCAGGTCAC
GCACGAAGGGAGCACCGTGGAGAAGACAGTGGCCCCTGCAGAATGTTCA
SEQ ID NO: 220
```

>N49P7.2
HEAVY CHAIN

*ADLVQSGAVVKKPGDSVRISCEAQGYKFPDYIIHWIRRAPGQGLEWMGWINPMGGQVNIPWQFQGRV
SMTRDTSIETAFLDLRGLKSDDTALYYCVRDRSNGSGRRFESSNWFLDLWGRGTAVTVHSPSYKGPSV*
FPLAPSSKSTSGGTAALGCLVKDYFPEPVTVSWNSGALTSGVHTFPAVLQSSGLYSLSSVVTVPSSS
LGTQTYICNVNHKPSNTKVDK<u>R</u>VEPKSCDKTHTCPPCPAPELLGGPSVFLFPPKPKDTLMISRTPEV
TCVVVDVSHEDPEVKFNWYVD<u>G</u>VEVHNAKTKPREEQYNSTYRVVSVLTVLHQDWLNGKEYKC
KVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGN<u>VF</u>SCSVMHEALHNHYTQKSLSLSPGK
SEQ ID NO: 221

```
GCGGACTTGGTGCAGTCTGGGGCTGTGGTGAAGAAGCCTGGGGACTCAGTGAGGATCTCCTGT
GAGGCTCAAGGATACAAATTTCCTGACTACATCATTCACTGGATTCGACGCGCCCCTGGACAA
GGCCTTGAGTGGATGGGGTGGATTAATCCAATGGGCGGACAAGTAAACATTCCATGGCAGTTT
CAGGGCAGGGTCTCCATGACCCGGGACACGTCCATCGAAACAGCATTTCTGGACTTAAGAGG
ACTAAAGTCTGACGACACGGCCCTCTATTATTGCGTGAGAGATCGAAGTAATGGATCGGGAA
GGCGATTCGAGTCCTCCAATTGGTTCCTCGATCTGTGGGGCCGCGGCACTGCGGTCACTGTTC
ATTCACCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCGT
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCAGCAGCTTGGGCACCCAGACCTACATCTT
GCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
```

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV antibodies are shown below. Variable regions within the heavy and
light chain in the amino acid sequence are italicized and changes
to the amino acid sequence relative to a natural antibody
sequence are underlined. CDR residues are in bold.

```
AACAAAGCCCTCCCAGCCCCCATCGAGAAAACCATCTCCAAAGCCAAAGGGCAGCCCCGAGA
ACCCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA
SEQ ID NO: 222
```

LIGHT CHAIN

*QSALTQPRSVSASPGQSVTISCTGT*HNL*VSWCQHHPGRAPKLLIY*DFN*KRPSGVPDRFSGSGSGGTASLT*
*ISGLQDDDDAEYFC*WAYEA*FGGGTKLTVLR*QPKAAPSVTLFPPSSEELQANKATLVCLISDFYPGAV
TVAWKADSSPVKAGVETTTPSKQSNNKYAASSYLSLTPEQWKSHRSYSCQVTHEGSTVEKTVAPT
ECS
SEQ ID NO: 223

```
CAGTCTGCCCTGACTCAGCCTCGCTCAGTGTCCGCATCTCCTGGGCAGTCCGTCACCATTTCCT
GCACTGGAACCCACAATTTGGTCTCTTGGTGTCAACATCACCCAGGCAGAGCCCCCAAATTAT
TAATTTATGACTTCAATAAGAGGCCCTCAGGGGTCCCTGATCGCTTCTCTGGCTCCGGGTCTGG
CGGCACGGCCTCCCTGACCATCAGTGGACTCCAGGATGACGATGACGCCGAATATTTTGTTG
GGCGTATGAAGCTTTTGGCGGAGGGACCAAGTTGACCGTACTTCGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 224
```

>N49P11
HEAVY CHAIN

*SAELVQSGAVVKKPGTSVKVSCQAY*GYTFTDYL *IHWLRQAPGQGLEWMGW*MNPVYGQ*VNYAQNFQG*
*RVSMTRDIYRETAFLEVRDLKTDDTGTYYC*VRDTGDGSRRHFDSINWFLDL*WGRGTWIRV*APASYKG
PSVFPLAPSSKSTSGGTAALGCLVKDYFPEPVTVSWNSGALTSGVHTFPAVLQSSGLYSLSSVVTVP
SSSLGTQTYICNVNHKPSNTKVDKRVEPKSCDKTHTCPPCPAPELLGGPSVFLFPPKPKDTLMISRT
PEVTCVVVDVSHEDPEVKFNWYVDGVEVHNAKTKPREEQYNSTYRVVSVLTVLHQDWLNGKEY
KCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK
SEQ ID NO: 225

```
TCGGCGGAATTGGTGCAATCTGGGGCTGTGGTGAAGAAGCCTGGGACCTCCGTGAAGGTCTCT
TGTCAGGCTTATGGATACACTTTTACCGACTACCTTATTCATTGGCTTCGACAGGCCCCTGGAC
AAGGACTTGAATGGATGGGATGGATGAATCCTGTTTATGGACAAGTAAATTATGCCCAAAACT
TTCAGGGCAGGGTCTCCATGACCAGGGACATTTACAGGGAAACAGCATTTCTAGAGGTGCGC
GACCTGAAGACTGACGACACAGGCACTTATTATTGTGTGAGAGACACAGGCGACGGTTCGCG
GAGACACTTTGACTCCATCAATTGGTTTCTCGATCTTTGGGGCCGCGGGACATGGATAAGGGT
CGCCCCCAGCCTCCACCAAGGGCCCATCGGTCTTCCCCCTGGCACCCTCCTCCAAGAGCACCTC
TGGGGGCACAGCGGCCCTGGGCTGCCTGGTCAAGGACTACTTCCCCGAACCGGTGACGGTGTC
GTGGAACTCAGGCGCCCTGACCAGCGGCGTGCACACCTTCCCGGCTGTCCTACAGTCCTCAGG
ACTCTACTCCCTCAGCAGCGTGGTGACCGTGCCCTCCAGCAGCTTGGGCACCCAGACCTACAT
CTGCAACGTGAATCACAAGCCCAGCAACACCAAGGTGGACAAGAGAGTTGAGCCCAAATCTT
GTGACAAAACTCACACATGCCCACCGTGCCCAGCACCTGAACTCCTGGGGGGACCGTCAGTCT
TCCTCTTCCCCCCAAAACCCAAGGACACCCTCATGATCTCCCGGACCCCTGAGGTCACATGCG
TGGTGGTGGACGTGAGCCACGAAGACCCTGAGGTCAAGTTCAACTGGTACGTGGACGGCGTG
GAGGTGCATAATGCCAAGACAAAGCCGCGGGAGGAGCAGTACAACAGCACGTACCGGGTGG
TCAGCGTCCTCACCGTCCTGCACCAGGACTGGCTGAATGGCAAGGAGTACAAGTGCAAGGTCT
CCAACAAAGCCCTCCCAGCCCCCATCGAGAAAACCATCTCCAAAGCCAAAGGGCAGCCCCGA
GAACCACAGGTGTACACCCTGCCCCCATCCCGGGAGGAGATGACCAAGAACCAGGTCAGCCT
GACCTGCCTGGTCAAAGGCTTCTATCCCAGCGACATCGCCGTGGAGTGGGAGAGCAATGGGC
AGCCGGAGAACAACTACAAGACCACGCCTCCCGTGCTGGACTCCGACGGCTCCTTCTTCCTCT
ACAGCAAGCTCACCGTGGACAAGAGCAGGTGGCAGCAGGGGAACGTCTTCTCATGCTCCGTG
ATGCATGAGGCTCTGCACAACCACTACACGCAGAAGAGCCTCTCCCTGTCTCCGGGTAAA
SEQ ID NO: 226
```

LIGHT CHAIN

*QCVLTQPRSVSGSPGQSVTISCTGT*HNY *VSWCQHHPGNAPKLLLY*DFD*KRPSGISDRFSGSRSGNTASLT*

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

*ISGLQPEDEADYFC**WAFEA**FGGGTKVLVLRQPKAAPSVTLFPPSSEELQANKATLVCLISDFYPGAV*
TVAWKADSSPVKAGVETTTPSKQSNNKYAASSYLSLTPEQWKSHRSYSCQVTHEGSTVEKTVAPT
ECS
SEQ ID NO: 227

```
CAGTGTGTCTTGACTCAGCCTCGCTCAGTGTCCGGATCTCCTGGACAATCAGTCACCATCTCCT
GCACTGGAACTCACAATTATGTCTCCTGGTGTCAACACCACCCAGGCAACGCCCCCAAATTAT
TACTTTATGATTTCGACAAGCGGCCCTCAGGAATCTCTGATCGCTTCTCTGGCTCTAGGTCTGG
CAACACGGCCTCCCTGACCATCTCTGGCCTCCAGCCTGAGGATGAGGCCGATTACTTTTGTTG
GGCCTTTGAAGCCTTTGGCGGAGGGACCAAGGTGCTCGTCCTTCGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 228
```

>N49P18
HEAVY CHAIN

*ADLVQSGAVMKKPGDSVRISCEAR**GYTFTDYVIHWIRRAPGQGLEWMGWIDPPYGQV**NIPWNFQGRV*
*SMTRDTSIETAFLDLRGLKSDDTGLYYC**VRDRSNGWGKRFESSNWFLDL**WGRGTVVTVHSPSYKGPS*
VFPLAPSSKSTSGGTAALGCLVKDYFPEPVTVSWNSGALTSGVHTFPAVLQSSGLYSLSSVVTVPSS
SLGTQTYICNVNHKPSNTKVDKRVEPKSCDKTHTCPPCPAPELLGGPSVFLPPKPKDTLMISRTPE
VTCVVVDVSHEDPEVKFNWYVDG̱VEVHNAKTKPREEQYNSTYRVVSVLTVLHQDWLNGKEYK
CKVSNKALPAPIEKTISKAKGQPREPQVYTLPPSREEM̱TKNQVSLTCLVKGFYPSDIAVEWESNGQ
PENNYKTTPPVLDSDGSFFLYSKLTVDKSRWQQGNV̱FSCSVMHEALHNHYTQKSLSLSPGK
SEQ ID NO: 229

```
GCGGACTTGGTGCAGTCTGGGGCTGTGATGAAGAAGCCTGGGGACTCAGTGAGAATCTCCTGT
GAGGCTCGAGGATACACATTCACTGACTACGTCATTCACTGGATTCGACGCGCCCCTGGACAA
GGCCTTGAATGGATGGGTGGATTGATCCACCTTATGGACAAGTAAATATTCCATGGAATTTT
CAGGGCAGGGTCTCCATGACCCGGGACACGTCCATCGAAACAGCATTTCTGGACTTAAGAGG
TCTAAAGTCTGACGACACGGGCCTCTATTATTGCGTGAGAGATCGAAGTAATGGATGGGGAA
AGCGATTCGAGTCCTCCAATTGGTTCCTCGATCTGTGGGGCCGCGGCACCGTGGTCACTGTTC
ACTCACCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCGT
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGA
ACCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA
SEQ ID NO: 230
```

LIGHT CHAIN

*QSALTQPRSVSASPGQSVTISCTGT**HNLVSWCQHHPGRAPKLLIYDFN**KRPSGVPDRFSGSGSGGTASLT*
*ISGLQDDDDAEYFC**WAYEA**FGGGTKLTVLRQPKAAPSVTLFPPSSEELQANKATLVCLISDFYPGAV*
TVAWKADSSPVKAGVETTTPSKQSNNKYAASSYLSLTPEQWKSHRSYSCQVTHEGSTVEKTVAPT
ECS
SEQ ID NO: 231

```
CAGTCTGCCCTGACTCAGCCTCGCTCAGTGTCCGCATCTCCTGGGCAGTCCGTCACCATTTCCT
GCACTGGAACCCACAATTTGGTCTCTTGGTGTCAACATCACCCAGGCAGAGCCCCCAAGTTAT
TAATTTATGACTTCAATAAGAGGCCCTCAGGGGTCCCTGATCGCTTCTCTGGCTCCGGGTCTGG
CGGCACGGCCTCCCTAACCATCAGTGGACTCCAGGATGACGATGACGCCGAATATTTTTGTTG
GGCATATGAAGCTTTCGGCGGAGGGACCAAGTTGACTGTACTTCGTCAGCCCAAGGCTGCCCC
CTCGGTCACTCTGTTCCCGCCCTCCTCTGAGGAGCTTCAAGCCAACAAGGCCACACTGGTGTG
```

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

```
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 232
```

>N49P18.2
HEAVY CHAIN

*ADLVQSGAVMKKPGDSVRISCEAR*GYTFTDYV*IHWIRRAPGQGLEWMGW*IDPPYGQV*NIPWNFQGRV*
*SMTRDTSIETAFLDLRGLKSDDTGLYYC*VRDRSNGWGKRFESSNWFLDL*WGRGTVVTVHSPSYKGPS*
VFPLAPSSKSTSGGTAALGCLVKDYFPEPVTVSWNSGALTSGVHTFPAVLQSSGLYSLSSVVTVPSS
SLGTQTYICNVNHKPSNTKVDKRVEPKSCDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSR<u>E</u>EMTKNQVSLTCLVKGFYPSDIAVEWESNGQ
PENNYKTTPPVLDSDGSFFLYSKLTVDKSRWQQGN<u>V</u>F<u>S</u>CSVMHEALHNHYTQKSLSLSPGK
SEQ ID NO: 233

```
GCGGACTTGGTGCAGTCTGGGGCTGTGATGAAGAAGCCTGGGGACTCAGTGAGAATCTCCTGT
GAGGCTCGAGGATACACATTCACTGACTACGTCATTCACTGGATTCGACGCGCCCCTGGACAA
GGCCTTGAATGGATGGGGTGGATTGATCCACCTTATGGACAAGTAAATATTCCATGGAATTTT
CAGGGCAGGGTCTCCATGACCCGGGACACGTCCATCGAAACGCATTTCTGGACTTAAGAGG
TCTAAAGTCTGACGACACGGGCCTCTATTATTGCGTGAGAGATCGAAGTAATGGATGGGGAA
AGCGATTCGAGTCCTCCAATTGGTTCCTCGATCTGTGGGGCCGCGGCACTGTGGTCACTGTTC
ACTCACCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCGT
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGA
ACCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA
SEQ ID NO: 234
```

LIGHT CHAIN

*QSALTQPRSVSASPGQSVTISCTGT*HNL*VSWCQHHPGRAPKLLIY*DFN*KRPSGVPDRFSGSGSGGTASLT*
*ISGLQDDDDAEYFC*WAYEA*FGGGTKLTVLRQPKAAPSVTLFPPSSEELQANKATLVCLVSDFYPGAV*
TVAWKADGSPVKVGVETTKPSKQSNNKYAASSYLSLTPEQWKSHRSYSC<u>R</u>VTHEGSTV<u>E</u>KTVAP
<u>A</u>ECS
SEQ ID NO: 235

```
CAGTCTGCCCTGACTCAGCCTCGCTCAGTGTCCGCATCTCCTGGGCAGTCCGTCACCATTTCCT
GCACTGGAACCCACAATTTGGTCTCTTGGTGTCAACATCACCCAGGCAGAGCCCCCAAGTTAT
TAATTTATGACTTCAATAAGAGGCCCTCAGGGGTCCCTGATCGCTTCTCTGGCTCCGGGTCTGG
CGGCACGGCCTCCCTAACCATCAGTGGACTCCAGGATGACGATGACGCCGAATATTTTGTTG
GGCATATGAAGCTTTCGGCGGAGGGACCAAGTTGACTGTACTTCGTCAGCCCAAGGCTGCCCC
CTCGGTCACTCTGTTCCCACCCTCCTCTGAGGAGCTTCAAGCCAACAAGGCCACACTGGTGTG
TCTCGTAAGTGACTTCTACCCGGGAGCCGTGACAGTGGCTTGGAAGGCAGATGGCAGCCCCGT
CAAGGTGGGAGTGGAGACCACCAAACCCTCCAAACAAAGCAACAACAAGTATGCGGCCAGC
AGCTACCTGAGCCTGACGCCCGAGCAGTGGAAGTCCCACAGAAGCTACAGCTGCCGGGTCAC
GCATGAAGGGAGCACCGTGGAGAAGACAGTGGCCCCTGCAGAATGCTCT
SEQ ID NO: 236
```

>N49P18.1
HEAVY CHAIN

*ADLVQSGAVVKKPGDSVRISCEAQ*GYTFTDYV*IHWIRRAPGQGLEWMGW*INPGYGQV*NIPWNFQGRV*
*SMTRDTSIETAFLDLRGLKSDDTGLYYC*VRDRSNGWGKRFESSNWFLDL*WGRGTVVTVHSPSTKGPS*

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV antibodies are shown below. Variable regions within the heavy and
light chain in the amino acid sequence are italicized and changes
to the amino acid sequence relative to a natural antibody
sequence are underlined. CDR residues are in bold.

```
VFPLAPSSKSTSGGTAALGCLVKDYFPEPVTVSWNSGALTSGVHTFPAVLQSSGLYSLSSVVTVPSS
SLGTQTYICNVNHKPSNTKVDKRVEPKSCDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK
SEQ ID NO: 237

GCGGACTTGGTGCAGTCTGGGGCTGTGGTGAAGAAGCCTGGGGACTCAGTGAGAATCTCCTGT
GAGGCTCAAGGATACACATTCACTGACTACGTCATTCACTGGATTCGACGCGCCCCTGGACAA
GGCCTTGAATGGATGGGGTGGATTAATCCAGGTTATGGACAAGTAAATATTCCATGGAACTTT
CAGGGCAGGGTCTCCATGACCCGAGACACGTCCATCGAAACAGCATTTCTGGACTTAAGAGG
TCTAAAGTCTGACGACACGGGCCTCTATTATTGCGTGAGAGATCGAAGTAATGGATGGGGAA
AGCGATTCGAGTCCTCCAATTGTTCCTCGATCTGTGGGGCCGGCACTGTGGTCACTGTTC
ACTCACCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCGT
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGA
ACCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA
SEQ ID NO: 238
```

LIGHT CHAIN

```
QSALTQPRSMSASPGQSVTISCTGTHNLVSWCQHHPGRPPKLLIYDFNKRPSGVPDRFSGSGSGGTASLT
ISGLQDDDDAEYICWAYEAFGGGTKLTVLRQPKAAPSVTLFPPSSEELQANKATLVCLISDFYPGAVT
VAWKADSSPVKAGVETTTPSKQSNNKYAASSYLSLTPEQWKSHRSYSCQVTHEGSTVEKTVAPTE
CS
SEQ ID NO: 239

CAGTCTGCCCTGACTCAGCCTCGCTCAATGTCCGCATCTCCTGGGCAGTCCGTCACCATTTCCT
GCACTGGAACCCACAATTTGGTCTCTTGGTGTCAACATCACCCAGGCAGACCCCCCAAATTAT
TAATTTATGACTTCAATAAGAGGCCCTCAGGGGTCCCTGATCGTTCTCTGGCTCCGGGTCTGG
CGGCACGGCCTCCCTGACCATCAGTGGACTCCAGGATGACGATGACGCCGAATACATTTGTTG
GGCATATGAAGCTTTCGGCGGAGGGACCAAGTTGACCGTACTTCGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 240
```

>N49P19
HEAVY CHAIN

```
ADLVQSGAVVKNAGASVRVSCEAYGYTFVDYFIHWVRQAPGQGFEWMGYMDPLNGRPNIARKFQGRL
SLSRDRSSETSFLDLSGLRSDDSAVYYCVRDKSNGSGRRFDSSNWFLDLWGRGTRVSIFSASYKGPSNF
PLAPSSKSTSGGTAALGCLVKDYFPEPVTVSWNSGALTSGVHTFPAVLQSSGLYSLSSVVTVPSSSL
GTQTYICNVNHKPSNTKVDKRVEPKSCDKTHTCPPCPAPELLGGPSVFLFPPKPKDTLMISRTPEVT
CVVVDVSHEDPEVKFNWYVDGVEVHNAKTKPREEQYNSTYRVVSVLTVLHQDWLNGKEYKCK
VSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK
SEQ ID NO: 241

GCGGACTTGGTGCAGTCTGGGGCTGTGGTGAAAAATGCTGGGGCCTCAGTGAGGGTCTCCTGT
GAGGCTTATGGATACACATTCGTGGACTACTTCATTCATTGGGTCCGACAGGCCCCTGGACAA
GGCTTTGAATGGATGGGATACATGGATCCCTTGAACGGGCGCCCAAACATTGCGCGAAATTT
CAGGGCAGGCTCTCCCTGAGTCGAGATAGGTCCAGCGAAACTTCATTTCTGGACTTAAGTGGA
```

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

```
CTGAGGTCTGACGACTCGGCCGTCTATTATTGTGTGAGAGACAAGAGTAATGGATCGGGCAG
ACGGTTTGACTCGTCTAATTGGTTTCTCGATCTGTGGGGCCGTGGAACCCGGGTCAGTATTTTC
TCAGCCTCCACCAAGGGCCCATCGGTCTTCCCCCTGGCACCCTCCTCCAAGAGCACCTCTGGG
GGCACAGCGGCCCTGGGCTGCCTGGTCAAGGACTACTTCCCCGAACCGGTGACGGTGTCGTGG
AACTCAGGCGCCCTGACCAGCGGCGTGCACACCTTCCCGGCTGTCCTACAGTCCTCAGGACTC
TACTCCCTCAGCAGCGTGGTGACCGTGCCCTCCAGCAGCTTGGGCACCCAGACCTACATCTGC
AACGTGAATCACAAGCCCAGCAACACCAAGGTGGACAAGAGAGTTGAGCCCAAATCTTGTGA
CAAAACTCACACATGCCCACCGTGCCCAGCACCTGAACTCCTGGGGGACCGTCAGTCTTCCT
CTTCCCCCCAAAACCCAAGGACACCCTCATGATCTCCCGGACCCCTGAGGTCACATGCGTGGT
GGTGGACGTGAGCCACGAAGACCCTGAGGTCAAGTTCAACTGGTACGTGGACGGCGTGGAGG
TGCATAATGCCAAGACAAAGCCGCGGGAGGAGCAGTACAACAGCACGTACCGGGTGGTCAGC
GTCCTCACCGTCCTGCACCAGGACTGGCTGAATGGCAAGGAGTACAAGTGCAAGGTCTCCAA
CAAAGCCCTCCCAGCCCCCATCGAGAAAACCATCTCCAAAGCCAAAGGGCAGCCCCGAGAAC
CACAGGTGTACACCCTGCCCCCATCCCGGGAGGAGATGACCAAGAACCAGGTCAGCCTGACC
TGCCTGGTCAAAGGCTTCTATCCCAGCGACATCGCCGTGGAGTGGGAGAGCAATGGGCAGCC
GGAGAACAACTACAAGACCACGCCTCCCGTGCTGGACTCCGACGGCTCCTTCTTCCTCTACAG
CAAGCTCACCGTGGACAAGAGCAGGTGGCAGCAGGGGAACGTCTTCTCATGCTCCGTGATGC
ATGAGGCTCTGCACAACCACTACACGCAGAAGAGCCTCTCCCTGTCTCCGGGTAAA
```

LIGHT CHAIN

*QSALTQPRSVSATPGQSVTISCTGT*HNY *VSWCQQHPGRAPKLLIY*DFN*KRPSGVPDRFSGSGSGGTASLT*
*ITGLQDDDEADYFC*WAYDA *FGGGTKLTVLRQPKAAPSVTLFPPSSEELQANKATLVCLISDFYPGAV*
TVAWKADSSPVKAGVETTTPSKQSNNKYAASSYLSLTPEQWKSHRSYSCQVTHEGSTVEKTVAPT
ECS
SEQ ID NO: 243

```
CAGTCTGCCCTGACTCAGCCTCGCTCAGTGTCCGCAACTCCTGGACAGTCAGTCACCATCTCCT
GCACTGGAACCCACAATTATGTCTCTTGGTGTCAACAACATCCAGGCAGAGCCCCCAAATTAC
TAATTTATGACTTCAATAAGAGGCCCTCAGGGGTCCCGGATCGGCTTCTCTGGCTCCGGATCTG
GCGGCACGGCCTCCCTAACCATCACTGGACTCCAGGATGACGATGAAGCGGACTATTTTTGTT
GGGCCTATGATGCTTTTGGCGGAGGGACCAAGTTGACCGTCCTGCGTCAGCCCAAGGCTGCCC
CCTCGGTCACTCTGTTCCCGCCCTCCTCTGAGGAGCTTCAAGCCAACAAGGCCACACTGGTGT
GTCTCATAAGTGACTTCTACCCGGGAGCCGTGACAGTGGCTTGGAAAGCAGATAGCAGCCCC
GTCAAGGCGGGAGTGGAGACCACCACACCCTCCAAACAAAGCAACAACAAGTACGCGGCCA
GCAGCTATCTGAGCCTGACGCTGAGCAGTGGAAGTCCCACAGAAGCTACAGCTGCCAGGTC
ACGCATGAAGGGAGCACCGTGGAGAAGACAGTGGCCCCTACAGAATGTTCA
```

SEQ ID NO: 244

>N49P37
HEAVY CHAIN

*ADLVQSGAVVKKPGDSVRVSCEAY*GYTFSDYI *IHWIRRAPGRGLEWMGW*MNPMGGQV *NIPWNFQGR*
*VSMTRDTSIETAFLDLRGLRSDDTAVYYC*VRDRSNGSGKRFESSNWFLDL*WGRGTAVTISS*ASTKGPSV
FPLAPSSKSTSGGTAALGCLVKDYFPEPVTVSWNSGALTSGVHTFPAVLQSSGLYSLSSVV$\underline{\text{T}}$VPSSS
LGTQTYICNVNHKPSNTKVDK$\underline{\text{R}}$VEPKSCDKTHTCPPCPAPELLGGPSVFLFPPKPKDTLMISRTPEV
TCVVVDVSHEDPEVKFNWYVD$\underline{\text{G}}$VEVHNAKTKPREEQYNSTYRVVSVLTVLHQDWLNGKEYKC
KVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK
SEQ ID NO: 245

```
GCGGACTTGGTGCAGTCTGGGGCTGTGGTGAAGAAGCCTGGGGACTCAGTGAGGGTCTCCTGT
GAGGCTTATGGATACACATTCAGTGACTACATCATTCATTGGATTCGACGGGCCCCTGGACGA
GGCCTTGAATGGATGGGATGGATGAATCCGATGGGCGGACAAGTGAATATTCCGTGGAACTT
TCAGGGGAGAGTCTCCATGACCCGGGACACGTCCATCGAAACAGCATTTCTGGACTTAAGAG
GACTGAGGTCTGACGACACGGCCGTCTATTACTGTGTGAGAGATCGCAGCAATGGATCGGGC
AAGCGATTTGAGTCCTCCAATTGGTTCCTCGATCTGTGGGGCCGCGGGACCGCGGTCACTATT
TCCTCAGCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCGT
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
```

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

```
AACAAAGCCCTCCCAGCCCCCATCGAGAAAACCATCTCCAAAGCCAAAGGGCAGCCCCGAGA
ACCCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA
SEQ ID NO: 246
```

LIGHT CHAIN

*QSALTQPRSVSAAPGQSVTISCTGT**HNLVSWCQHHPGRAPKLLIYDFN**KRPSGVPDRFSGSGSGGTASLT
ITGLQDDDEAEYFC**WAYEV**FGGGTKLTVLG*QPKAAPSVTLFPPSSEELQANKATLVCLISDFYPGAV
TVAWKADSSPVKAGVETTTPSKQSNNKYAA̲SSYLSLTPEQWKSHRSYSCQVTHEGSTVEKTVAPT
ECS
SEQ ID NO: 247

```
CAGTCTGCCCTGACTCAGCCTCGCTCAGTGTCCGCAGCTCCTGGACAGTCCGTCACCATTTCCT
GCACTGGAACCCACAATTTGGTTTCTTGGTGTCAACATCACCCAGGCAGAGCCCCCAAGTTAT
TAATTTATGACTTCAATAAGAGACCCTCAGGTGTCCCTGATCGTTTCTCTGGCTCCGGGTCTGG
CGGCACGGCCTCCCTAACCATCACTGGACTCCAGGATGACGATGAGGCTGAATATTTTTGTTG
GGCGTATGAAGTTTTTGGCGGAGGGACCAAGTTGACCGTGCTTGGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 248
```

>N49P38
HEAVY CHAIN

*ADLVQSGAVVKTPGASVRVSCEAY**GYTFIDYIIHWVRQAPGQGFEWLGYIDPMNGRP**NIARKFQGRLSL
SRDTSIETSFLDLSGLRSDDSAVYYC**VRDKSNGSGKRFDSSNWFLDL**WGRGTRVSISS*ASYKGPSNFPL
APSSKSTSGGTAALGCLVKDYFPEPVTVSWNSGALTSGVHTFPAVLQSSGLYSLSSVVTVPSSSLG
TQTYICNVNHKPSNTKVDKRVEPKSCDKTHTCPPCPAPELLGGPSVFLFPPKPKDTLMISRTPEVTC
VVVDVSHEDPEVKFNWYVDG̲VEVHNAKTKPREEQYNSTYRVVSVLTVLHQDWLNGKEYKCKV
SNKALPAPIEKTISKAKGQPREPQVYTLPPSREEMTKNQVSLTCLVKGFYPSDIAVEWESNGQPEN
NYKTTPPVLDSDGSFFLYSKLTVDKSRWQQGNVF̲SCSVMHEALHNHYTQKSLSLSPGK
SEQ ID NO: 249

```
GCGGACTTGGTGCAGTCTGGGGCTGTGGTGAAGACGCCTGGGGCCTCAGTGAGGGTCTCCTGT
GAGGCTTATGGATACACATTCATTGACTACATCATTCATTGGGTCCGACAGGCCCCTGGACAA
GGTTTTGAATGGCTGGGATACATTGATCCTATGAACGGGCGCCCAAACATTGCGCGAAAATTT
CAGGGCAGGCTCTCCCTGAGCCGGGATACGTCCATCGAAACATCATTTCTGGACTTAAGTGGA
CTGAGGTCTGACGACTCGGCCGTCTATTATTGTGTGAGAGACAAGAGTAATGGATCGGGCAA
ACGATTTGACTCCTCTAATTGGTTTCTCGATCTGTGGGCCGTGAACGCGGGTCAGCATTTCT
TCAGCCTCCACCAAGGGCCCATCGGTCTTCCCCCTGGCACCCTCCTCCAAGAGCACCTCTGGG
GGCACAGCGGCCCTGGGCTGCCTGGTCAAGGACTACTTCCCCGAACCGGTGACGGTGTCGTGG
AACTCAGGCGCCCTGACCAGCGGCGTGCACACCTTCCCGGCTGTCCTACAGTCCTCAGGACTC
TACTCCCTCAGCAGCGTGGTGACCGTGCCCTCCAGCAGCTTGGGCACCCAGACCTACATCTGC
AACGTGAATCACAAGCCCAGCAACACCAAGGTGGACAAGAGAGTTGAGCCCAAATCTTGTGA
CAAAACTCACACATGCCCACCGTGCCCAGCACCTGAACTCCTGGGGGGACCGTCAGTCTTCCT
CTTCCCCCCAAAACCCAAGGACACCCTCATGATCTCCCGGACCCCTGAGGTCACATGCGTGGT
GGTGGACGTGAGCCACGAAGACCCTGAGGTCAAGTTCAACTGGTACGTGGACGGCGTGGAGG
TGCATAATGCCAAGACAAAGCCGCGGGAGGAGCAGTACAACAGCACGTACCGGGTGGTCAGC
GTCCTCACCGTCCTGCACCAGGACTGGCTGAATGGCAAGGAGTACAAGTGCAAGGTCTCCAA
CAAAGCCCTCCCAGCCCCCATCGAGAAAACCATCTCCAAAGCCAAAGGGCAGCCCCGAGAAC
CACAGGTGTACACCCTGCCCCCATCCCGGGAGGAGATGACCAAGAACCAGGTCAGCCTGACC
TGCCTGGTCAAAGGCTTCTATCCCAGCGACATCGCCGTGGAGTGGGAGAGCAATGGGCAGCC
GGAGAACAACTACAAGACCACGCCTCCCGTGCTGGACTCCGACGGCTCCTTCTTCCTCTACAG
CAAGCTCACCGTGGACAAGAGCAGGTGGCAGCAGGGGAACGTCTTCTCATGCTCCGTGATGC
ATGAGGCTCTGCACAACCACTACACGCAGAAGAGCCTCTCCCTGTCTCCGGGTAAA
SEQ ID NO: 250
```

LIGHT CHAIN

*QSALTQPRSVSAAPGQSVTISCTGT**HNYVSWCQQHPGRAPKLLIYDFN**KRPSGVPDRFSGSGSGGTASLT*

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

*ITRLQDDDDADYFCWAYDAFGGGTKLTVL*GQPKAAPSVTLFPPSSEELQANKATLVCLISDFYPGAV
TVAWKADSSPVKAGVETTTPSKQSNNKYAASSYLSLTPEQWKSHRSYSCQVTHEGSTVEKTVAPT
ECS
SEQ ID NO: 251

CAGTCTGCCCTGACTCAGCCTCGCTCAGTGTCCGCAGCTCCTGGACAGTCAGTCACCATCTCCT
GCACTGGAACCCACAATTATGTCTCTTGGTGTCAACAACATCCAGGCAGAGCCCCCAAATTAC
TAATTTATGACTTCAATAAGAGGCCCTCAGGGGTCCCGGATCGCTTCTCTGGCTCCGGATCTG
GCGGCACGGCCTCCCTAACCATCACTAGACTCCAGGATGACGATGACGCTGACTATTTTTGTT
GGGCGTATGATGCTTTTGGCGGAGGGACCAAGTTGACCGTCCTGGGTCAGCCCAAGGCTGCCC
CCTCGGTCACTCTGTTCCCGCCCTCCTCTGAGGAGCTTCAAGCCAACAAGGCCACACTGGTGT
GTCTCATAAGTGACTTCTACCCGGGAGCCGTGACAGTGGCTTGGAAAGCAGATAGCAGCCCC
GTCAAGGCGGGAGTGGAGACCACCACACCCTCCAAACAAAGCAACAACAAGTACGCGGCCA
GCAGCTATCTGAGCCTGACGCCTGAGCAGTGGAAGTCCCACAGAAGCTACAGCTGCCAGGTC
ACGCATGAAGGGAGCACCGTGGAGAAGACAGTGGCCCCTACAGAATGTTCA
SEQ ID NO: 252

>N49P38.1
HEAVY CHAIN

*ADLVQSGAVVKTPGASVRVSCEAYGYTFIDYIIHWVRQAPGQGFEWLGYIDPMNGRPNIARKFQGRLSL
SRDTSIETSFLDLSGLRSDDSAVYYCVRDKSNGSGKRFDSSNWFLDLWGRGTRVSISS*ASYKGPSNFPL
APSSKSTSGGTAALGCLVKDYFPEPVTVSWNSGALTSGVHTFPAVLQSSGLYSLSSVVTVPSSSLG
TQTYICNVNHKPSNTKVDKRVEPKSCDKTHTCPPCPAPELLGGPSVFLFPPKPKDTLMISRTPEVTC
VVVDVSHEDPEVKFNWYVDGVEVHNAKTKPREEQYNSTYRVVSVLTVLHQDWLNGKEYKCKV
SNKALPAPIEKTISKAKGQPREPQVYTLPPSREEMTKNQVSLTCLVKGFYPSDIAVEWESNGQPEN
NYKTTPPVLDSDGSFFLYSKLTVDKSRWQQGNVFSCSVMHEALHNHYTQKSLSLSPGK
SEQ ID NO: 253

GCGGACTTGGTGCAGTCTGGGGCTGTGGTGAAGACGCCTGGGGCCTCAGTGAGGGTCTCCTGT
GAGGCTTATGGATACACATTCATTGACTACATCATTCATTGGGTCCGACAGGCCCCTGGACAA
GGTTTTGAATGGCTGGGATACATTGATCCTATGAACGGGCGCCCAAACATTGCGCGAAAATTT
CAGGGCAGGCTCTCCCTGAGCCGGGATACGTCCATCGAAACATCATTTCTGGACTTAAGTGGA
CTGAGGTCTGACGACTCGGCCGTCTATTATTGTGTGAGAGACAAGAGTAATGGATCGGGCAA
ACGATTTGACTCCTCTAATTGGTTTCTCGATCTGTGGGGCCGTGGAACGCGGGTCAGCATTTCT
TCAGCCTCCACCAAGGGCCCATCGGTCTTCCCCCTGGCACCCTCCTCCAAGAGCACCTCTGGG
GGCACAGCGGCCCTGGGCTGCCTGGTCAAGGACTACTTCCCCGAACCGGTGACGGTGTCGTGG
AACTCAGGCGCCCTGACCAGCGGCGTGCACACCTTCCCGGCTGTCCTACAGTCCTCAGGACTC
TACTCCCTCAGCAGCGTGGTGACCGTGCCCTCCAGCAGCTTGGGCACCCAGACCTACATCTGC
AACGTGAATCACAAGCCCAGCAACACCAAGGTGGACAAGAGAGTTGAGCCCAAATCTTGTGA
CAAAACTCACACATGCCCACCGTGCCCAGCACCTGAACTCCTGGGGGGACCGTCAGTCTTCCT
CTTCCCCCCAAAACCCAAGGACACCCTCATGATCTCCCGGACCCCTGAGGTCACATGCGTGGT
GGTGGACGTGAGCCACGAAGACCCTGAGGTCAAGTTCAACTGGTACGTGGACGGCGTGGAGG
TGCATAATGCCAAGACAAAGCCGCGGGAGGAGCAGTACAACAGCACGTACCGGGTGGTCAGC
GTCCTCACCGTCCTGCACCAGGACTGGCTGAATGGCAAGGAGTACAAGTGCAAGGTCTCCAA
CAAAGCCCTCCCAGCCCCCATCGAGAAAACCATCTCCAAAGCCAAAGGGCAGCCCCGAGAAC
CACAGGTGTACACCCTGCCCCCATCCCGGGAGGAGATGACCAAGAACCAGGTCAGCCTGACC
TGCCTGGTCAAAGGCTTCTATCCCAGCGACATCGCCGTGGAGTGGGAGAGCAATGGGCAGCC
GGAGAACAACTACAAGACCACGCCTCCCGTGCTGGACTCCGACGGCTCCTTCTTCCTCTACAG
CAAGCTCACCGTGGACAAGAGCAGGTGGCAGCAGGGGAACGTCTTCTCATGCTCCGTGATGC
ATGAGGCTCTGCACAACCACTACACGCAGAAGAGCCTCTCCCTGTCTCCGGGTAAA
SEQ ID NO: 254

LIGHT CHAIN

*QSALTQPRSVSAAPGQSVTISCTGTHNYVSWCQQHPGRAPKLLIYDFNKRPSGVPDRFSGSGSGGTASLT
ITRLQDDDDADYFCWAYDAFGGGTKLTVL*RQPKAAPSVTLFPPSSEELQANKATLVCLISDFYPGAV
TVAWKADSSPVKAGVETTTPSKQSNNKYAASSYLSLTPEQWKSHRSYSCQVTHEGSTVEKTVAPT
ECS
SEQ ID NO: 255

CAGTCTGCCCTGACTCAGCCTCGCTCAGTGTCCGCAGCTCCTGGACAGTCAGTCACCATCTCCT
GCACTGGAACCCACAATTATGTCTCTTGGTGTCAACAACATCCAGGCAGAGCCCCCAAATTAC
TAATTTATGACTTCAATAAGAGGCCCTCAGGGGTCCCGGATCGCTTCTCTGGCTCCGGATCTG
GCGGCACGGCCTCCCTAACCATCACTAGACTCCAGGATGACGATGACGCTGACTATTTTTGTT
GGGCGTATGATGCTTTTGGCGGAGGGACCAAGTTGACCGTCCTGCGTCAGCCCAAGGCTGCCC
CCTCGGTCACTCTGTTCCCGCCCTCCTCTGAGGAGCTTCAAGCCAACAAGGCCACACTGGTGT

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

```
GTCTCATAAGTGACTTCTACCCGGGAGCCGTGACAGTGGCTTGGAAAGCAGATAGCAGCCCC
GTCAAGGCGGGAGTGGAGACCACCACACCCTCCAAACAAAGCAACAACAAGTACGCGGCCA
GCAGCTATCTGAGCCTGACGCCTGAGCAGTGGAAGTCCCACAGAAGCTACAGCTGCCAGGTC
ACGCATGAAGGGAGCACCGTGGAGAAGACAGTGGCCCCTACAGAATGTTCA
SEQ ID NO: 256
```

>N49P55
HEAVY CHAIN

*ADLVQSGAVVKKPGASVRVSCEAY*GYTFTDYI *IHWIRQAPGQGLEWMGW*MNPMGGRT *NIPWKFQGR*
*VSMTRDTSIETAFLDLSGLTSDDTAVYYC*VRDKSNGSGKRFDSSNWFLDL*WGRGTPVTISS*PSTKGPSV
FPLAPSSKSTSGGTAALGCLVKDYFPEPVTVSWNSGALTSGVHTFPAVLQSSGLYSLSSVVTVPSSS
LGTQTYICNVNHKPSNTKVDKRVEPKSCDKTHTCPPCPAPELLGGPSVFLFPPKPKDTLMISRTPEV
TCVVVDVSHEDPEVKFNWYVDG̲VEVHNAKTKPREEQYNSTYRVVSVLTVLHQDWLNGKEYKC
KVSNKALPAPIEKTISKAKGQPREPQVYTLPPSREE̲MTKNQVSLTCLVKGFYPSDIAVEWESNGQP
ENNYKTTPPVLDSDGSFFLYSKLTVDKSRWQQGNV̲FSCSVMHEALHNHYTQKSLSLSPGK
SEQ ID NO: 257

```
GCGGACTTGGTGCAGTCTGGGGCTGTGGTGAAGAAGCCTGGGGCCTCAGTGAGGGTCTCCTGT
GAGGCTTATGGATACACATTCACTGACTACATCATTCATTGGATTCGACAGGCCCCTGGACAA
GGCCTTGAATGGATGGGATGGATGAATCCTATGGGCGGGCGCACAAATATTCCGTGGAAATTT
CAGGGCAGGGTCTCCATGACCCGGGACACGTCCATCGAAACGCATTTCTGGACTTAAGTGG
ACTAACGTCTGACGACACGGCCGTCTATTATTGCGTGAGAGACAAGAGTAATGGATCGGGCA
AACGATTTGACTCCTCTAATTGGTTCCTCGATCTGTGGGGCCGCGGAACCCGGTCACTATTTC
CTCACCCTCCACCAAGGGCCCATCGGTCTTCCCCCTGGCACCCTCCTCCAAGAGCACCTCTGG
GGGCACAGCGGCCCTGGGCTGCCTGGTCAAGGACTACTTCCCCGAACCGGTGACGGTGTCGTG
GAACTCAGGCGCCCTGACCAGCGGCGTGCACACCTTCCCGGCTGTCCTACAGTCCTCAGGACT
CTACTCCCTCAGCAGCGTGGTGACCGTGCCCTCCAGCAGCTTGGGCACCCAGACCTACATCTG
CAACGTGAATCACAAGCCCAGCAACACCAAGGTGGACAAGAGAGTTGAGCCCAAATCTTGTG
ACAAAACTCACACATGCCCACCGTGCCCAGCACCTGAACTCCTGGGGGGACCGTCAGTCTTCC
TCTTCCCCCCAAAACCCAAGGACACCCTCATGATCTCCCGGACCCCTGAGGTCACATGCGTGG
TGGTGGACGTGAGCCACGAAGACCCTGAGGTCAAGTTCAACTGGTACGTGGACGGCGTGGAG
GTGCATAATGCCAAGACAAAGCCGCGGGAGGAGCAGTACAACAGCACGTACCGGGTGGTCAG
CGTCCTCACCGTCCTGCACCAGGACTGGCTGAATGGCAAGGAGTACAAGTGCAAGGTCTCCA
ACAAAGCCCTCCCAGCCCCCATCGAGAAAACCATCTCCAAAGCCAAAGGGCAGCCCCGAGAA
CCACAGGTGTACACCCTGCCCCCATCCCGGGAGGAGATGACCAAGAACCAGGTCAGCCTGAC
CTGCCTGGTCAAAGGCTTCTATCCCAGCGACATCGCCGTGGAGTGGGAGAGCAATGGGCAGC
CGGAGAACAACTACAAGACCACGCCTCCCGTGCTGGACTCCGACGGCTCCTTCTTCCTCTACA
GCAAGCTCACCGTGGACAAGAGCAGGTGGCAGCAGGGGAACGTCTTCTCATGCTCCGTGATG
CATGAGGCTCTGCACAACCACTACACGCAGAAGAGCCTCTCCCTGTCTCCGGGTAAA
SEQ ID NO: 258
```

LIGHT CHAIN

*QSALTQPRSVSAAPGQSVTISCTGT*HNL*VSWCQQHPGRAPKLLIY*DFN*KRPSGVPDRFSGSGSGGTASLS*
*ITGLQDDDEAEYF*WAYEA*FGGGTKLTVLR*QPKAAPSVTLFPPSSEELQANKATLVCLISDFYPGAV
TVAWKADSSPVKAGVETTTPSKQSNNKYAASSYLSLTPEQWKSHRSYSCQVTHEGSTVEKTVAPT
ECS
SEQ ID NO: 259

```
CAGTCTGCCCTGACTCAGCCTCGCTCAGTGTCCGCAGCTCCTGGACAGTCCGTCACCATTTCCT
GCACTGGAACCCACAATTTGGTCTCTTGGTGTCAACAACACCCAGGCAGAGCCCCCAAATTAT
TAATTTATGACTTCAATAAGAGGCCCTCAGGGGTCCCTGATCGCTTCTCTGGCTCCGGGTCTGG
CGGCACGGCCTCCCTAAGTATCACTGGACTCCAGGATGACGATGAAGCTGAATATTTTTGTTG
GGCGTATGAAGCTTTTGGCGGAGGGACCAAGTTGACCGTCCTTCGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 260
```

>N49P56
HEAVY CHAIN

*ADLVQSGAVVKKPGASVRVSCEAY*GYTFVDYL *IHWVRQAPGQGFEWMGY*MDPMNGRP*NIARKFQGR*
*LSLSRDTSIETSFLDLSGLRSDDSAVYYC*VRDKSGGSGKLFDSSNWFLDL*WGRGTRVSISS*ASYKGPSNF

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

```
PLAPSSKSTSGGTAALGCLVKDYFPEPVTVSWNSGALTSGVHTFPAVLQSSGLYSLSSVVTVPSSSL
GTQTYICNVNHKPSNTKVDKRVEPKSCDKTHTCPPCPAPELLGGPSVFLFPPKPKDTLMISRTPEVT
CVVVDVSHEDPEVKFNWYVDGVEVHNAKTKPREEQYNSTYRVVSVLTVLHQDWLNGKEYKCK
VSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK
SEQ ID NO: 261

GCGGACTTGGTGCAGTCTGGGGCTGTGGTGAAGAAGCCTGGGGCCTCAGTGCGGGTCTCCTGT
GAGGCTTATGGATATACATTCGTTGACTACCTCATTCATTGGGTCCGACAGGCCCCGGACAA
GGTTTTGAATGGATGGGATACATGGATCCTATGAACGGGCGCCCAAATATTGCGCGAAAATTT
CAGGGCAGGCTCTCCCTGAGCCGAGATACGTCCATCGAAACATCATTTCTGGACTTAAGTGGA
CTGAGGTCTGACGACTCGGCCGTCTATTATTGTGTGAGAGACAAGAGTGGTGGATCGGGCAA
ACTATTTGACTCCTCTAATTGGTTTCTCGATCTGTGGGGCCGGGTCAGCATTTCT
TCAGCCTCCACCAAGGGCCCATCGGTCTTCCCCCTGGCACCCTCCTCCAAGAGCACCTCTGGG
GGCACAGCGGCCCTGGGCTGCCTGGTCAAGGACTACTTCCCCGAACCGGTGACGGTGTCGTGG
AACTCAGGCGCCCTGACCAGCGGCGTGCACACCTTCCCGGCTGTCCTACAGTCCTCAGGACTC
TACTCCCTCAGCAGCGTGGTGACCGTGCCCTCCAGCAGCTTGGGCACCCAGACCTACATCTGC
AACGTGAATCACAAGCCCAGCAACACCAAGGTGGACAAGAGAGTTGAGCCCAAATCTTGTGA
CAAAACTCACACATGCCCACCGTGCCCAGCACCTGAACTCCTGGGGGGACCGTCAGTCTTCCT
CTTCCCCCCAAAACCCAAGGACACCCTCATGATCTCCCGGACCCCTGAGGTCACATGCGTGGT
GGTGGACGTGAGCCACGAAGACCCTGAGGTCAAGTTCAACTGGTACGTGGACGGCGTGGAGG
TGCATAATGCCAAGACAAAGCCGCGGGAGGAGCAGTACAACAGCACGTACCGGGTGGTCAGC
GTCCTCACCGTCCTGCACCAGGACTGGCTGAATGGCAAGGAGTACAAGTGCAAGGTCTCCAA
CAAAGCCCTCCCAGCCCCCATCGAGAAAACCATCTCCAAAGCCAAAGGGCAGCCCCGAGAAC
CACAGGTGTACACCCTGCCCCCATCCCGGGAGGAGATGACCAAGAACCAGGTCAGCCTGACC
TGCCTGGTCAAAGGCTTCTATCCCAGCGACATCGCCGTGGAGTGGGAGAGCAATGGGCAGCC
GGAGAACAACTACAAGACCACGCCTCCCGTGCTGGACTCCGACGGCTCCTTCTTCCTCTACAG
CAAGCTCACCGTGGACAAGAGCAGGTGGCAGCAGGGGAACGTCTTCTCATGCTCCGTGATGC
ATGAGGCTCTGCACAACCACTACACGCAGAAGAGCCTCTCCCTGTCTCCGGGTAAA
SEQ ID NO: 262
```

LIGHT CHAIN

```
QSALTQPRSVSAAPGQSVTISCTGTHNY VSWCQQHPGRAPKLLIYDFNKRPSGVPDRFSGSGSGGTASLT
ITGLQDDDDADYFCWAYDAFGGGTKLTVLRQPKAAPSVTLFPPSSEELQANKATLVCLISDFYPGAV
TVAWKADSSPVKAGVETTTPSKQSNNKYAASSYLSLTPEQWKSHRSYSCQVTHEGSTVEKTVAPT
ECS
SEQ ID NO: 263

CAGTCTGCCCTGACTCAGCCTCGCTCAGTGTCCGCAGCTCCTGGACAGTCAGTCACCATCTCCT
GCACCGGAACTCACAATTATGTCTCTTGGTGTCAACAACATCCAGGCAGAGCCCCCAAATTAC
TAATTTATGACTTCAATAAGAGGCCCTCAGGGGTCCCGGATCTGCTTCTCTGGCTCCGGATCTG
GCGGCACGGCCTCCCTAACCATCACTGGACTCCAGGATGACGATGACGCTGATTATTTTTGTT
GGGCGTATGATGCTTTTGGCGGAGGGACCAAGTTGACCGTCCTGCGTCAGCCCAAGGCTGCCC
CCTCGGTCACTCTGTTCCCGCCCTCCTCTGAGGAGCTTCAAGCCAACAAGGCCACACTGGTGT
GTCTCATAAGTGACTTCTACCCGGGAGCCGTGACAGTGGCTTGGAAAGCAGATAGCAGCCCC
GTCAAGGCGGGAGTGGAGACCACCACACCCTCCAAACAAAGCAACAACAAGTACGCGGCCA
GCAGCTATCTGAGCCTGACGCCTGAGCAGTGGAAGTCCCACAGAAGCTACAGCTGCCAGGTC
ACGCATGAAGGGAGCACCGTGGAGAAGACAGTGGCCCCTACAGAATGTTCA
SEQ ID NO: 264
```

>N49P57
HEAVY CHAIN

```
ADLVQSGAVVKKPGDSVRISCEAQGYTFTDYVIHWIRRAPGQGLEWMGWINPGYGQVNIPWNFQGRV
SMTRDTSIETAFLELRGLKSDDTGLYYCVRDRSNGWGKRFESSNWFLDLWGRGTVITVHSPSTKGPSV
FPLAPSSKSTSGGTAALGCLVKDYFPEPVTVSWNSGALTSGVHTFPAVLQSSGLYSLSSVVTVPSSS
LGTQTYICNVNHKPSNTKVDKRVEPKSCDKTHTCPPCPAPELLGGPSVFLFPPKPKDTLMISRTPEV
TCVVVDVSHEDPEVKFNWYVDGVEVHNAKTKPREEQYNSTYRVVSVLTVLHQDWLNGKEYKC
KVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK
SEQ ID NO: 265

GCGGACTTGGTGCAGTCTGGGGCTGTGGTGAAGAAGCCTGGGGACTCAGTGAGAATCTCCTGT
GAGGCTCAAGGATACACATTCACTGACTACGTCATTCACTGGATTCGACGGGCCCCTGGACAA
GGCCTTGAATGGATGGGGTGGATTAATCCAGGTTATGGACAAGTAAATATTCCATGGAACTTT
CAGGGCAGGGTCTCCATGACCCGAGACACGTCCATCGAAACAGCTTTTCTGGAGTTAAGAGGT
CTAAAGTCTGACGACACGGGCCTCTATTATTGCGTGAGAGATCGAAGTAATGGATGGGGAAA
```

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

```
GCGATTCGAGTCCTCCAATTGGTTCCTCGATCTGTGGGGCCGCGGCACTGTGATTACTGTTCAC
TCACCCTCCACCAAGGGCCCATCGGTCTTCCCCCTGGCACCCTCCTCCAAGAGCACCTCTGGG
GGCACAGCGGCCCTGGGCTGCCTGGTCAAGGACTACTTCCCCGAACCGGTGACGGTGTCGTGG
AACTCAGGCGCCCTGACCAGCGGCGTGCACACCTTCCCGGCTGTCCTACAGTCCTCAGGACTC
TACTCCCTCAGCAGCGTGGTGACCGTGCCCTCCAGCAGCTTGGGCACCCAGACCTACATCTGC
AACGTGAATCACAAGCCCAGCAACACCAAGGTGGACAAGAGAGTTGAGCCCAAATCTTGTGA
CAAAACTCACACATGCCCACCGTGCCCAGCACCTGAACTCCTGGGGGGACCGTCAGTCTTCCT
CTTCCCCCCAAAACCCAAGGACACCCTCATGATCTCCCGGACCCCTGAGGTCACATGCGTGGT
GGTGGACGTGAGCCACGAAGACCCTGAGGTCAAGTTCAACTGGTACGTGGACGGCGTGGAGG
TGCATAATGCCAAGACAAAGCCGCGGGAGGAGCAGTACAACAGCACGTACCGGGTGGTCAGC
GTCCTCACCGTCCTGCACCAGGACTGGCTGAATGGCAAGGAGTACAAGTGCAAGGTCTCCAA
CAAAGCCCTCCCAGCCCCCATCGAGAAAACCATCTCCAAAGCCAAAGGGCAGCCCCGAGAAC
CACAGGTGTACACCCTGCCCCCATCCCGGGAGGAGATGACCAAGAACCAGGTCAGCCTGACC
TGCCTGGTCAAAGGCTTCTATCCCAGCGACATCGCCGTGGAGTGGGAGAGCAATGGGCAGCC
GGAGAACAACTACAAGACCACGCCTCCCGTGCTGGACTCCGACGGCTCCTTCTTCCTCTACAG
CAAGCTCACCGTGGACAAGAGCAGGTGGCAGCAGGGGAACGTCTTCTCATGCTCCGTGATGC
ATGAGGCTCTGCACAACCACTACACGCAGAAGAGCCTCTCCCTGTCTCCGGGTAAA
SEQ ID NO: 266
```

LIGHT CHAIN

*QSALTQPRSMSASPGQSVTISCTGTHNLVSWCQHHPGRPPKLLIYDFNKRPSGVPDRFSGSGSGGTASLT
ITGLQDDDDAEYICWAYEAFGGGTKLTILRQPKAAPSVTLFPPSSEELQANKATLVCLISDFYPGAVT*
VAWKADSSPVKAGVETTTPSKQSNNKYAASSYLSLTPEQWKSHRSYSCQVTHEGSTVEKTVAPTE
CS
SEQ ID NO: 267

```
CAGTCTGCCCTGACTCAGCCTCGCTCAATGTCCGCATCTCCTGGGCAGTCCGTCACCATTTCCT
GCACTGGAACCCACAATTTGGTCTCTTGGTGTCAACATCACCCAGGCAGACCCCCCAAATTAT
TAATTTATGACTTCAATAAGAGGCCCTCAGGGGTCCCTGATCGCTTCTCTGGCTCCGGATCTGG
CGGCACGGCCTCCCTGACCATCACTGGACTCCAGGATGACGATGACGCCGAATACATTTGTTG
GGCATATGAAGCTTTCGGCGGAGGGACCAAGTTGACCATACTTCGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 268
```

>N49P58
HEAVY CHAIN

*ADLVQSGAVVKKPGDSVRISCEAQGYTFTDYVIHWIRRAPGQGLEWMGWMDPSYGQVNIPRNFQGRV
SMTRDTFRETAYLELRGLQSDDKGLYYCVRDRSHGSGRQFESSNWFLDLWGRGTVVNVQSPSAKGPS*
VFPLAPSSKSTSGGTAALGCLVKDYFPEPVTVSWNSGALTSGVHTFPAVLQSSGLYSLSSVVTVPSS
SLGTQTYICNVNHKPSNTKVDKRVEPKSCDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK
SEQ ID NO: 269

```
GCGGACTTGGTGCAGTCTGGGGCTGTGGTGAAGAAGCCTGGGGACTCAGTGAGAATCTCCTGT
GAGGCTCAGGGATATACATTCACCGACTACGTCATTCATTGGATTCGACGGGCCCCTGGACAA
GGCCTTGAATGGATGGGGTGGATGGATCCAAGTTATGGACAAGTCAATATTCCACGGAACTTT
CAGGGCAGGGTCTCCATGACCCGGGACACGTTCAGGGAAACAGCATATCTGGAATTAAGAGG
TCTACAGTCTGACGACAAGGGCCTCTATTATTGTGTGAGAGATCGAAGTCACGGATCGGGAAG
GCAATTCGAGTCCTCCAACTGGTTCCTCGATCTGTGGGGCCGCGGCACTGTGGTCAATGTTCA
GTCACCCTCCACCAAGGGCCCATCGGTCTTCCCCCTGGCACCCTCCTCCAAGAGCACCTCTGG
GGGCACAGCGGCCCTGGGCTGCCTGGTCAAGGACTACTTCCCCGAACCGGTGACGGTGTCGTG
GAACTCAGGCGCCCTGACCAGCGGCGTGCACACCTTCCCGGCTGTCCTACAGTCCTCAGGACT
CTACTCCCTCAGCAGCGTGGTGACCGTGCCCTCCAGCAGCTTGGGCACCCAGACCTACATCTG
CAACGTGAATCACAAGCCCAGCAACACCAAGGTGGACAAGAGAGTTGAGCCCAAATCTTGTG
ACAAAACTCACACATGCCCACCGTGCCCAGCACCTGAACTCCTGGGGGGACCGTCAGTCTTCC
TCTTCCCCCCAAAACCCAAGGACACCCTCATGATCTCCCGGACCCCTGAGGTCACATGCGTGG
TGGTGGACGTGAGCCACGAAGACCCTGAGGTCAAGTTCAACTGGTACGTGGACGGCGTGGAG
GTGCATAATGCCAAGACAAAGCCGCGGGAGGAGCAGTACAACAGCACGTACCGGGTGGTCAG
CGTCCTCACCGTCCTGCACCAGGACTGGCTGAATGGCAAGGAGTACAAGTGCAAGGTCTCCA
ACAAAGCCCTCCCAGCCCCCATCGAGAAAACCATCTCCAAAGCCAAAGGGCAGCCCCGAGAA
```

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

```
CCACAGGTGTACACCCTGCCCCCATCCCGGGAGGAGATGACCAAGAACCAGGTCAGCCTGAC
CTGCCTGGTCAAAGGCTTCTATCCCAGCGACATCGCCGTGGAGTGGGAGAGCAATGGGCAGC
CGGAGAACAACTACAAGACCACGCCTCCCGTGCTGGACTCCGACGGCTCCTTCTTCCTCTACA
GCAAGCTCACCGTGGACAAGAGCAGGTGGCAGCAGGGGAACGTCTTCTCATGCTCCGTGATG
CATGAGGCTCTGCACAACCACTACACGCAGAAGAGCCTCTCCCTGTCTCCGGGTAAA
SEQ ID NO: 270
```

LIGHT CHAIN

*QSALTQPRSVSASPGQSVTISCTGT*HNL*VSWCQHHPGRPPKLLIY*DFN*KRASGVPDRFSGSGSGGTASLT
ISGLQDDDDAEYFC*WAYEA*FGGGTKLTVLR*QPKAAPSVTLFPPSSEELQANKATLVCLISDFYPGAV
TVAWKADSSPVKAGVETTTPSKQSNNKYAASSYLSLTPEQWKSHRSYSCQVTHEGSTVEKTVAPT
ECS
SEQ ID NO: 271

```
CAGTCTGCCCTGACTCAGCCTCGCTCAGTGTCCGCATCTCCTGGGCAGTCCGTCACCATTTCCT
GCACTGGAACCCACAATTTGGTCTCTTGGTGTCAACATCACCCAGGCAGACCTCCCAAATTAT
TAATTTATGACTTCAATAAGAGGGCTTCAGGGGTCCCTGATCGCTTCTCTGGCTCCGGGTCTGG
CGGCACGGCCTCCCTGACCATTAGTGGACTCCAGGATGACGATGACGCCGAATATTTTTGTTG
GGCATATGAAGCTTTCGGCGGAGGGACCAAGTTGACCGTACTTCGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 272
```

>N49P59
HEAVY CHAIN

*ADLVQSGAVVKKPGDSLRISCEAQ*GYTFTDYV*IHWIRRAPGQGLEWMGW*MDPSFGQM*NIPRNFQGRV
SMTRDMYIETAFLDLRGLKSDDTGLYY*C**VRDRSHGSGRLFESSNWFLDL*WGRGTWTVQSPSYKGPS*
VFPLAPSSKSTSGGTAALGCLVKDYFPEPVTVSWNSGALTSGVHTFPAVLQSSGLYSLSSVVTVPSS
SLGTQTYICNVNHKPSNTKVDKRVEPKSCDKTHTCPPCPAPELLGGPSVFLFPPKPKDTLMISRTPE
VTCVVVDVSHEDPEVKFNWYVDG̲VEVHNAKTKPREEQYNSTYRVVSVLTVLHQDWLNGKEYK
CKVSNKALPAPIEKTISKAKGQPREPQVYTLPPSREE̲MTKNQVSLTCLVKGFYPSDIAVEWESNGQ
PENNYKTTPPVLDSDGSFFLYSKLTVDKSRWQQGNV̲FSCSVMHEALHNHYTQKSLSLSPGK
SEQ ID NO: 273

```
GCGGACTTGGTGCAGTCTGGGGCTGTGGTGAAGAAGCCTGGGGACTCACTGAGAATCTCCTGT
GAGGCTCAAGGATACACATTCACTGACTACGTCATTCACTGGATTCGACGGGCCCCTGGACAA
GGCCTTGAATGGATGGGATGGATGGATCCAAGTTTTGGACAAATGAACATTCCACGGAACTTT
CAGGGCAGGGTCTCCATGACCCGTGACATGTACATCGAAACAGCATTTCTGGACTTAAGAGGT
CTAAAGTCTGACGACACGGGCCTCTATTATTGCGTGAGAGATCGAAGTCATGGATCGGGAAG
CTATTCGAGTCCTCCAATTGGTTCCTCGATCTGTGGGGCCGCGGCACTGTGGTCACTGTTCAG
TCACCCTCCACCAAGGGCCCATCGGTCTTCCCCCTGGCACCCTCCTCCAAGAGCACCTCTGGG
GGCACAGCGGCCCTGGGCTGCCTGGTCAAGGACTACTTCCCCGAACCGGTGACGGTGTCGTGG
AACTCAGGCGCCCTGACCAGCGGCGTGCACACCTTCCCGGCTGTCCTACAGTCCTCAGGACTC
TACTCCCTCAGCAGCGTGGTGACCGTGCCCTCCAGCAGCTTGGGCACCCAGACCTACATCTGC
AACGTGAATCACAAGCCCAGCAACACCAAGGTGGACAAGAGAGTTGAGCCCAAATCTTGTGA
CAAAACTCACACATGCCCACCGTGCCCAGCACCTGAACTCCTGGGGGGACCGTCAGTCTTCCT
CTTCCCCCCAAAACCCAAGGACACCCTCATGATCTCCCGGACCCCTGAGGTCACATGCGTGGT
GGTGGACGTGAGCCACGAAGACCCTGAGGTCAAGTTCAACTGGTACGTGGACGGCGTGGAGG
TGCATAATGCCAAGACAAAGCCGCGGGAGGAGCAGTACAACAGCACGTACCGGGTGGTCAGC
GTCCTCACCGTCCTGCACCAGGACTGGCTGAATGGCAAGGAGTACAAGTGCAAGGTCTCCAA
CAAAGCCCTCCCAGCCCCATCGAGAAAACCATCTCCAAAGCCAAAGGGCAGCCCCGAGAAC
CACAGGTGTACACCCTGCCCCCATCCCGGGAGGAGATGACCAAGAACCAGGTCAGCCTGACC
TGCCTGGTCAAAGGCTTCTATCCCAGCGACATCGCCGTGGAGTGGGAGAGCAATGGGCAGCC
GGAGAACAACTACAAGACCACGCCTCCCGTGCTGGACTCCGACGGCTCCTTCTTCCTCTACAG
CAAGCTCACCGTGGACAAGAGCAGGTGGCAGCAGGGGAACGTCTTCTCATGCTCCGTGATGC
ATGAGGCTCTGCACAACCACTACACGCAGAAGAGCCTCTCCCTGTCTCCGGGTAAA
SEQ ID NO: 274
```

LIGHT CHAIN

*QSALTQPRSVSASPGQSVTISCTGT*HNL*VSWCQHHPGRPPKLLIY*DFN*KRASGVPDRFSGSGSGGTASLT
ISGLQDDDDAEYFC*WAYEA*FGGGTKLTVLR*QPKAAPSVTLFPPSSEELQANKATLVCLISDFYPGAV

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

TVAWKADSSPVKAGVETTTPSKQSNNKYAASSYLSLTPEQWKSHRSYSCQVTHEGSTVEKTVAPT
ECS
SEQ ID NO: 275

CAGTCTGCCCTGACTCAGCCTCGCTCAGTGTCCGCATCTCCTGGGCAGTCCGTCACCATTTCCT
GCACTGGAACCCACAATTTGGTCTCTTGGTGTCAACATCACCCAGGCAGACCTCCCAAATTAT
TAATTTATGACTTCAATAAGAGGGCTTCAGGGGTCCCTGATCGCTTCTCTGGCTCCGGGTCTGG
CGGCACGGCCTCCCTGACCATTAGTGGACTCCAGGATGACGATGACGCCGAATATTTTTGTTG
GGCATATGAAGCTTTCGGCGGAGGGACCAAGTTGACCGTACTTCGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 276

>N49P73
HEAVY CHAIN

*ADLVQSGAVVKKPGDSVRISCEAQ**GRYFTDYVIHWIRRAPGQGLEWMGLMDPSFGRM**NIPRKFQGRV
SMTRDTSMETAFLDFRGLNFDDTGLYYC**VRDRSHGSGRLFESSNWFLDL**WGRGTVVTVQSPSAKGPS*
VFPLAPSSKSTSGGTAALGCLVKDYFPEPVTVSWNSGALTSGVHTFPAVLQSSGLYSLSSVVTVPSS
SLGTQTYICNVNHKPSNTKVDKRVEPKSCDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK
SEQ ID NO: 277

GCGGACTTGGTGCAGTCTGGGGCTGTGGTGAAGAAGCCTGGGGACTCAGTGAGAATCTCCTGT
GAGGCTCAAGGATACAGATTCACTGACTACGTCATTCATTGGATTCGAGCGGCCCCTGGACAA
GGCCTTGAATGGATGGGGTTGATGGATCCAAGTTTTGGACGAATGAATATTCCACGGAAATTT
CAGGGCAGGGTCTCCATGACCCGGGACACGTCCATGGAAACAGCATTTCTGGACTTCAGAGG
TCTAAATTTTGACGACACGGGCCTCTATTATTGCGTGAGAGATCGAAGTCATGGATCGGGAAG
ACTATTCGAGTCCTCCAATTGTTCCTCGATCTGTGGGCCGCGGCACTGTGGTCACTGTTCAG
TCACCCTCCACCAAGGGCCCATCGGTCTTCCCCCTGGCACCCTCCTCCAAGAGCACCTCTGGG
GGCACAGCGGCCCTGGGCTGCCTGGTCAAGGACTACTTCCCCGAACCGGTGACGGTGTCGTGG
AACTCAGGCGCCCTGACCAGCGGCGTGCACACCTTCCCGGCTGTCCTACAGTCCTCAGGACTC
TACTCCCTCAGCAGCGTGGTGACCGTGCCCTCCAGCAGCTTGGGCACCCAGACCTACATCTGC
AACGTGAATCACAAGCCCAGCAACACCAAGGTGGACAAGAGAGTTGAGCCCAAATCTTGTGA
CAAAACTCACACATGCCCACCGTGCCCAGCACCTGAACTCCTGGGGGGACCGTCAGTCTTCCT
CTTCCCCCCAAAACCCAAGGACACCCTCATGATCTCCCGGACCCCTGAGGTCACATGCGTGGT
GGTGGACGTGAGCCACGAAGACCCTGAGGTCAAGTTCAACTGGTACGTGGACGGCGTGGAGG
TGCATAATGCCAAGACAAAGCCGCGGGAGGAGCAGTACAACAGCACGTACCGGGTGGTCAGC
GTCCTCACCGTCCTGCACCAGGACTGGCTGAATGGCAAGGAGTACAAGTGCAAGGTCTCCAA
CAAAGCCCTCCCAGCCCCCATCGAGAAAACCATCTCCAAAGCCAAAGGGCAGCCCCGAGAAC
CACAGGTGTACACCCTGCCCCCATCCCGGGAGGAGATGACCAAGAACCAGGTCAGCCTGACC
TGCCTGGTCAAAGGCTTCTATCCCAGCGACATCGCCGTGGAGTGGGAGAGCAATGGGCAGCC
GGAGAACAACTACAAGACCACGCCTCCCGTGCTGGACTCCGACGGCTCCTTCTTCCTCTACAG
CAAGCTCACCGTGGACAAGAGCAGGTGGCAGCAGGGGAACGTCTTCTCATGCTCCGTGATGC
ATGAGGCTCTGCACAACCACTACACGCAGAAGAGCCTCTCCCTGTCTCCGGGTAAA
SEQ ID NO: 278

LIGHT CHAIN

*QSALTQPRSVSASPGQSVTISCTGT**HNLVSWCQHHPGRPPKLLIYDFN**KRASGVPDRFSGSGSGGTASLT
ISGLQDDDDAEYFC**WAYEA**FGGGTKLTVLRQPKAAPSVTLFPPSSEELQANKATLVCLISDFYPGAV*
TVAWKADSSPVKAGVETTTPSKQSNNKYAASSYLSLTPEQWKSHRSYSCQVTHEGSTVEKTVAPT
ECS
SEQ ID NO: 279

CAGTCTGCCCTGACTCAGCCTCGCTCAGTGTCCGCATCTCCTGGGCAGTCCGTCACCATTTCCT
GCACTGGAACCCACAATTTGGTCTCTTGGTGTCAACATCACCCAGGCAGACCTCCCAAATTAT
TAATTTATGACTTCAATAAGAGGGCATCAGGGGTCCCTGATCGCTTCTCTGGCTCCGGGTCTG
GCGGCACGGCCTCCCTGACCATCAGTGGACTCCAAGATGACGATGACGCCGAATATTTTTGTT
GGGCATATGAAGCTTTCGGCGGAGGGACCAAGTTGACCGTACTTCGTCAGCCCAAGGCTGCCC
CCTCGGTCACTCTGTTCCCGCCCTCCTCTGAGGAGCTTCAAGCCAACAAGGCCACACTGGTGT
GTCTCATAAGTGACTTCTACCCGGGAGCCGTGACAGTGGCTTGGAAAGCAGATAGCAGCCCC
GTCAAGGCGGGAGTGGAGACCACCACACCCTCCAAACAAAGCAACAACAAGTACGCGGCCA

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

```
GCAGCTATCTGAGCCTGACGCCTGAGCAGTGGAAGTCCCACAGAAGCTACAGCTGCCAGGTC
ACGCATGAAGGGAGCACCGTGGAGAAGACAGTGGCCCCTACAGAATGTTCA
SEQ ID NO: 280
```

>N49P74
HEAVY CHAIN

*ADLVQSGAVVKKPGDSVRISCEAQ*GYTFIDYV*IHWIRRAPGQGLEWMG*L*MDPTYGRM*NIPRKFQGRVS*
*MTRDTSIETAFLDLRGLKSDDTGLYYC*VRDRSHGSGRLFESSNWFLDL*WGRGTVVTVQSPSYKGPSVF*
PLAPSSKSTSGGTAALGCLVKDYFPEPVTVSWNSGALTSGVHTFPAVLQSSGLYSLSSVVTVPSSSL
GTQTYICNVNHKPSNTKVDKRVEPKSCDKTHTCPPCPAPELLGGPSVFLPPKPKDTLMISRTPEVT
CVVVDVSHEDPEVKFNWYVDG̲VEVHNAKTKPREEQYNSTYRVVSVLTVLHQDWLNGKEYKCK
VSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNV̲F̲S̲CSVMHEALHNHYTQKSLSLSPGK
SEQ ID NO: 281

```
GCGGACTTGGTGCAGTCTGGGGCTGTGGTGAAGAAGCCTGGGGACTCAGTGAGAATTTCCTGT
GAGGCTCAAGGATACACATTCATTGACTACGTCATTCACTGGATTCGACGGGCCCCTGGACAA
GGCCTTGAATGGATGGGGTTGATGGATCCAACTTATGGACGAATGAATATTCCACGGAAGTTT
CAGGGCAGGGTCTCCATGACCCGGGACACGTCCATCGAAACAGCATTTCTGGACTTAAGAGG
TCTAAAATCTGACGACACGGGCCTCTATTATTGCGTGAGAGATCGAAGTCATGGATCGGGAAG
GCTATTCGAGTCCTCCAACTGGTTCCTGGATCTGTGGGGCGCGGCACTGTGGTCACTGTTCA
GTCACCCTCCACCAAGGGCCCATCGGTCTTCCCCCTGGCACCCTCCTCCAAGAGCACCTCTGG
GGGCACAGCGGCCCTGGGCTGCCTGGTCAAGGACTACTTCCCCGAACCGGTGACGGTGTCGTG
GAACTCAGGCGCCCTGACCAGCGGCGTGCACACCTTCCCGGCTGTCCTACAGTCCTCAGGACT
CTACTCCCTCAGCAGCGTGGTGACCGTGCCCTCCAGCAGCTTGGGCACCCAGACCTACATCTG
CAACGTGAATCACAAGCCCAGCAACACCAAGGTGGACAAGAGAGTTGAGCCCAAATCTTGTG
ACAAAACTCACACATGCCCACCGTGCCCAGCACCTGAACTCCTGGGGGGACCGTCAGTCTTCC
TCTTCCCCCCAAAACCCAAGGACACCCTCATGATCTCCCGGACCCCTGAGGTCACATGCGTGG
TGGTGGACGTGAGCCACGAAGACCCTGAGGTCAAGTTCAACTGGTACGTGGACGGCGTGGAG
GTGCATAATGCCAAGACAAAGCCGCGGGAGGAGCAGTACAACAGCACGTACCGGGTGGTCAG
CGTCCTCACCGTCCTGCACCAGGACTGGCTGAATGGCAAGGAGTACAAGTGCAAGGTCTCCA
ACAAAGCCCTCCCAGCCCCCATCGAGAAAACCATCTCCAAAGCCAAAGGGCAGCCCCGAGAA
CCACAGGTGTACACCCTGCCCCCATCCCGGGAGGAGATGACCAAGAACCAGGTCAGCCTGAC
CTGCCTGGTCAAAGGCTTCTATCCCAGCGACATCGCCGTGGAGTGGGAGAGCAATGGGCAGC
CGGAGAACAACTACAAGACCACGCCTCCCGTGCTGGACTCCGACGGCTCCTTCTTCCTCTACA
GCAAGCTCACCGTGGACAAGAGCAGGTGGCAGCAGGGGAACGTCTTCTCATGCTCCGTGATG
CATGAGGCTCTGCACAACCACTACACGCAGAAGAGCCTCTCCCTGTCTCCGGGTAAA
SEQ ID NO: 282
```

LIGHT CHAIN

*QSALTQPRSVSASPGQSVTISCTGT*HNL*VSWCQHHPGRPPKLLIY*DFN*KRASGVPDRFSGSGSGGTASLT*
*ISGLQDDDDAEYFC*WAYEA*FGGGTKLTVLRQPKAAPSVTLFPPSSEELQANKATLVCLISDFYPGAV*
TVAWKADSSPVKAGVETTTPSKQSNNKYAASSYLSLTPEQWKSHRSYSCQVTHEGSTVEKTVAPT
ECS
SEQ ID NO: 283

```
CAGTCTGCCCTGACTCAGCCTCGCTCAGTGTCCGCATCTCCTGGGCAGTCCGTCACCATTTCCT
GCACTGGAACCCACAATTTGGTCTCTTGGTGTCAACATCACCCAGGCAGACCTCCCAAATTAT
TAATTTATGACTTCAATAAGAGGGCTTCAGGGGTCCCTGATCGCTTCTCTGGCTCCGGGTCTGG
CGGCACGGCCTCCCTGACCATCAGTGGACTCCAAGATGACGATGACGCCGAATATTTTTGTTG
GGCATATGAAGCTTTCGGCGGAGGGACCAAGTTGACCGTACTTCGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 284
```

>N49P75
HEAVY CHAIN

*ADLVQSGAVVKKPGDSVRISCEAQ*GYRFLDYI*IHWIRRAPGQGLEWMG*W*MNPMGGQV*NIPWNFQGR*
*VSMTRDTSIETAFLDLRGLKSDDTAVYYC*VRDRSNGSG*KRFESSNWFLDL***WGRGTAVTIHSPSAKGPS*
VFPPLAPSSKSTSGGTAALGCLVKDYFPEPVTVSWNSGALTSGVHTFPAVLQSSGLYSLSSVVTVPSS
SLGTQTYICNVNHKPSNTKVDKRVEPKSCDKTHTCPPCPAPELLGGPSVFLPPKPKDTLMISRTPE
VTCVVVDVSHEDPEVKFNWYVDG̲VEVHNAKTKPREEQYNSTYRVVSVLTVLHQDWLNGKEYK

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

CKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK
SEQ ID NO: 285

GCGGACTTGGTGCAGTCTGGGGCTGTGGTGAAGAAGCCTGGGGACTCAGTGAGGATCTCCTGT
GAGGCTCAAGGATACAGATTTCTTGACTACATCATTCACTGGATTCGACGAGCCCCTGGACAA
GGCCTTGAATGGATGGGATGGATGAATCCAATGGGCGGACAAGTAAACATTCCATGGAACTT
TCAGGGTAGGGTCTCCATGACCCGGGACACGTCCATCGAAACAGCATTTCTGGACTTAAGAGG
ACTAAAGTCTGACGACACGGCCGTCTATTATTGCGTGAGAGATCGCAGTAATGGATCGGGAA
AGCGATTCGAGTCCTCCAATTGGTTCCTCGATCTGTGGGGCCGCGGGACTGCGGTCACTATTC
ATTCACCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCGT
GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGA
ACCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA
SEQ ID NO: 286

LIGHT CHAIN

*QSALTQPRSVSASPGQSVTISCTGT*HNL*VSWCQHHPGRAPKLLIY*DFN*KRPSGVPDRFSGSGSGGTASLT
ITGLQDDDDAEYFC*WAYEA*FGGGTKLTVLR*QPKAAPSVTLFPPSSEELQANKATLVCLISDFYPGAV
TVAWKADSSPVKAGVETTTPSKQSNNKYAASSYLSLTPEQWKSHRSYSCQVTHEGSTVEKTVAPT
ECS
SEQ ID NO: 287

CAGTCTGCCCTGACTCAGCCTCGCTCAGTGTCCGCATCTCCTGGGCAGTCCGTCACCATTTCCT
GCACTGGAACCCACAATTTGGTCTCTTGGTGTCAACATCACCAGGCAGAGCCCCCAAATTAT
TAATTTATGACTTCAATAAGAGGCCCTCAGGGGTCCCTGATCGCTTCTCTGGCTCCGGGTCTGG
CGGCACGGCCTCCCTGACCATCACTGGACTCCAGGATGACGATGACGCCGAATATTTTTGTTG
GGCGTATGAAGCTTTTGGCGGAGGGACCAAGTTGACCGTACTTCGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 288

>N49P75.1
HEAVY CHAIN

*ADLVQSGAVVKKPGDSVRISCEAQ*GYRFLDYI*IHWIRRAPGQGLEWMGW*MNPMGGQV*NIPWNFQGR
VSMTRDTSIETAFLDLRGLKSDDTAVYYC*VRDRSNGSGKRFESSNWFLDL*WGRGTAVTIHSA*SAKGPS
VFPLAPSSKSTSGGTAALGCLVKDYFPEPVTVSWNSGALTSGVHTFPAVLQSSGLYSLSSVVTVPSS
SLGTQTYICNVNHKPSNTKVDKRVEPKSCDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK
SEQ ID NO: 289

GCGGACTTGGTGCAGTCTGGGGCTGTGGTGAAGAAGCCTGGGGACTCAGTGAGGATCTCCTGT
GAGGCTCAAGGATACAGATTTCTTGACTACATCATTCACTGGATTCGACGAGCCCCTGGACAA
GGCCTTGAATGGATGGGATGGATGAATCCAATGGGCGGACAAGTAAACATTCCATGGAACTT
TCAGGGTAGGGTCTCCATGACCCGGGACACGTCCATCGAAACAGCATTTCTGGACTTAAGAGG
ACTAAAGTCTGACGACACGGCCGTCTATTATTGCGTGAGAGATCGCAGTAATGGATCGGGAA
AGCGATTCGAGTCCTCCAATTGGTTCCTCGATCTGTGGGGCCGCGGGACTGCGGTCACTATTC
ATTCAGCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTCGT

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

GGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGACCGTCAGTCTTC
CTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGGGTGGTCA
GCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGA
ACCACAGGTGTACACCCTGCCCCCATCCCGGGAGGAGATGACCAAGAACCAGGTCAGCCTGA
CCTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA
SEQ ID NO: 290

LIGHT CHAIN

QSALTQPRSVSASPGQSVTISCTGT*HNL*VSWCQHHPGRAPKLLIY*DFN*KRPSGVPDRFSGSGSGGTASLT
ITGLQDDDDAEYFC*WAYEA*FGGGTKLTVLGQPKAAPSVTLFPPSSEELQANKATLVCLISDFYPGAV
TVAWKADSSPVKAGVETTTPSKQSNNKYAA̲SSYLSLTPEQWKSHRSYSCQVTHEGSTVEKTVAPT
ECS
SEQ ID NO: 291

CAGTCTGCCCTGACTCAGCCTCGCTCAGTGTCCGCATCTCCTGGGCAGTCCGTCACCATTTCCT
GCACTGGAACCCACAATTTGGTCTCTTGGTGTCAACATCACCCAGGCAGAGCCCCCAAATTAT
TAATTTATGACTTCAATAAGAGGCCCTCAGGGGTCCCTGATCGCTTCTCTGGCTCCGGGTCTGG
CGGCACGGCCTCCCTGACCATCACTGGACTCCAGGATGACGATGACGCCGAATATTTTTGTTG
GGCGTATGAAGCTTTTGGCGGAGGGACCAAGTTGACCGTACTTGGTCAGCCCAAGGCTGCCCC
CTCGGTCACTCTGTTCCCGCCCTCCTCTGAGGAGCTTCAAGCCAACAAGGCCACACTGGTGTG
TCTCATAAGTGACTTCTACCCGGGAGCCGTGACAGTGGCTTGGAAAGCAGATAGCAGCCCCGT
CAAGGCGGGAGTGGAGACCACCACACCCTCCAAACAAAGCAACAACAAGTACGCGGCCAGC
AGCTATCTGAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA
SEQ ID NO: 292

>N49P9
HEAVY CHAIN

*HVQLVQSGGGVKKIGAAVRISCEVT*GYKFMDQLI*NWVRQAPGQGLEWMGW*MNPTYGQV*NYSWRFEG
RVTMTRDMDTETAFMELRGLRVDDTAVYYC**ARGPSGENYPFHY*WGQGVRWVSSP*SYKGPSNFPLAP
SSKSTSGGTAALGCLVKDYFPEPVTVSWNSGALTSGVHTFPAVLQSSGLYSLSSVVTVPSSSLGTQ
TYICNVNHKPSNTKVDKRVEPKSCDKTHTCPPCPAPELLGGPSVFLFPPKPKDTLMISRTPEVTCVV
VDVSHEDPEVKFNWYVDG̲VEVHNAKTKPREEQYNSTYRVVSVLTVLHQDWLNGKEYKCKVSN
KALPAPIEKTISKAKGQPREPQVYTLPPSREEMTKNQVSLTCLVKGFYPSDIAVEWESNGQPENNY
KTTPPVLDSDGSFFLYSKLTVDKSRWQQGN̲VFSCSVMHEALHNHYTQKSLSLSPGK
SEQ ID NO: 293

CACGTCCAATTGGTGCAGTCTGGAGGTGGGGTGAAGAAGATTGGGGCCGCTGTGAGGATCTC
CTGCGAGGTGACTGGATATAAATTCATGGACCAACTCATAAACTGGGTGCGGCAGGCCCCCG
GTCAGGGCCTTGAGTGGATGGGATGGATGAATCCAACATATGGACAAGTAAATTATTCATGG
AGATTTGAAGGAAGGGTCACCATGACCAGGGACATGGACACCGAGACGGCCTTCATGGAGTT
GAGAGGACTGAGAGTGGACGACACGGCCGTCTATTATTGCGCGAGGGGACCCTCTGGGGAAA
ATTATCCTTTTCACTATTGGGGCCAGGGTGTCCGAGTGGTCGTCTCGTCACCCTCCACCAAGGG
CCCATCGGTCTTCCCCCTGGCACCCTCCTCCAAGAGCACCTCTGGGGGCACAGCGGCCCTGGG
CTGCCTGGTCAAGGACTACTTCCCCGAACCGGTGACGGTGTCGTGGAACTCAGGCGCCCTGAC
CAGCGGCGTGCACACCTTCCCGGCTGTCCTACAGTCCTCAGGACTCTACTCCCTCAGCAGCGT
GGTGACCGTGCCCTCCAGCAGCTTGGGCACCCAGACCTACATCTGCAACGTGAATCACAAGCC
CAGCAACACCAAGGTGGACAAGAGAGTTGAGCCCAAATCTTGTGACAAAACTCACACATGCC
CACCGTGCCCAGCACCTGAACTCCTGGGGGACCGTCAGTCTTCCTCTTCCCCCCAAAACCCA
AGGACACCCTCATGATCTCCCGGACCCCTGAGGTCACATGCGTGGTGGTGGACGTGAGCCACG
AAGACCCTGAGGTCAAGTTCAACTGGTACGTGGACGGCGTGGAGGTGCATAATGCCAAGACA
AAGCCGCGGGAGGAGCAGTACAACAGCACGTACCGGGTGGTCAGCGTCCTCACCGTCCTGCA
CCAGGACTGGCTGAATGGCAAGGAGTACAAGTGCAAGGTCTCCAACAAAGCCCTCCCAGCCC
CCATCGAGAAAACCATCTCCAAAGCCAAAGGGCAGCCCCGAGAACCACAGGTGTACACCCTG
CCCCCATCCCGGGAGGAGATGACCAAGAACCAGGTCAGCCTGACCTGCCTGGTCAAAGGCTT
CTATCCCAGCGACATCGCCGTGGAGTGGGAGAGCAATGGGCAGCCGGAGAACAACTACAAGA
CCACGCCTCCCGTGCTGGACTCCGACGGCTCCTTCTTCCTCTACAGCAAGCTCACCGTGGACA

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

```
AGAGCAGGTGGCAGCAGGGGAACGTCTTCTCATGCTCCGTGATGCATGAGGCTCTGCACAAC
CACTACACGCAGAAGAGCCTCTCCCTGTCTCCGGGTAAA
SEQ ID NO: 294
```

LIGHT CHAIN

*ASALTQPASMSASPGQSVTISCSGTRHIISAWFQQYPGKPPKLIIF<sup>DDD</sup>KRPSGVPSRFSASRPGDTASLTI
SNVQPEDEATYICNTYEFFGGGTRLTVLS*QPKAAPSVTLFPPSSEELQANKATLVCLVSDFYPGAVTV
AWKADGSPVKVGVETTKPSKQSNNKYAASSYLSLTPEQWKSHRSYSCRVTHEGSTVEKTVAPAE
CS
SEQ ID NO: 295

```
GCATCTGCCCTGACTCAGCCTGCCTCCATGTCTGCGTCCCCTGGACAGTCGGTAACCATCTCGT
GCTCTGGAACCAGACACATAATCTCTGCTTGGTTCCAACAATATCCAGGCAAACCACCCAAAC
TCATAATTTTTGACGACGATAAGCGTCCCTCTGGAGTTCCTAGTCGCTTCTCTGCCTCCAGGCC
TGGCGACACGGCCTCCCTGACAATCTCTAATGTTCAACCTGAGGACGAGGCGACGTACATTTG
CAATACATATGAATTCTTTGGCGGAGGGACCAGATTGACCGTCCTAAGTCAGCCCAAGGCTGC
CCCCTCGGTCACTCTGTTCCCACCCTCCTCTGAGGAGCTTCAAGCCAACAAGGCCACACTGGT
GTGTCTCGTAAGTGACTTCTACCCGGGAGCCGTGACAGTGGCCTGGAAGGCAGATGGCAGCC
CCGTCAAGGTGGGAGTGGAGACCACCAAACCCTCCAAACAAAGCAACAACAAGTATGCGGCC
AGCAGCTACCTGAGCCTGACGCCCGAGCAGTGGAAGTCCCACAGAAGCTACAGCTGCCGGGT
CACGCATGAAGGGAGCACCGTGGAGAAGACAGTGGCCCCTGCAGAATGCTCT
SEQ ID NO: 296
```

>N49P9.1
HEAVY CHAIN

*HVQLVQSGGGVKKIGAAVRISCEVTGYKFMDQLINWVRQAPGQGLEWMGWMNPTYGQVNYSWRFEG
RVTMTRDMDTETAFMELRGLRVDDTAVYYCARGPSGENYPFHY*WGQGVRWVSSPSYKGPSNFPLAP
SSKSTSGGTAALGCLVKDYFPEPVTVSWNSGALTSGVHTFPAVLQSSGLYSLSSVVTVPSSSLGTQ
TYICNVNHKPSNTKVDKRVEPKSCDKTHTCPPCPAPELLGGPSVFLFPPKPKDTLMISRTPEVTCVV
VDVSHEDPEVKFNWYVDG̲VEVHNAKTKPREEQYNSTYRVVSVLTVLHQDWLNGKEYKCKVSN
KALPAPIEKTISKAKGQPREPQVYTLPPSR̲EEMTKNQVSLTCLVKGFYPSDIAVEWESNGQPENNY
KTTPPVLDSDGSFFLYSKLTVDKSRWQQGN̲VFS̲CSVMHEALHNHYTQKSLSLSPGK
SEQ ID NO: 297

```
CACGTCCAATTGGTGCAGTCTGGAGGTGGGGTGAAGAAGATTGGGGCCGCTGTGAGGATCTC
CTGCGAGGTGACTGGATATAAATTCATGGACCAACTCATAAACTGGGTGCGGCAGGCCCCG
GTCAGGGCCTTGAGTGGATGGGATGGATGAATCCAACATATGGACAAGTAAATTATTCATGG
AGATTTGAAGGAAGGGTCACCATGACCAGGGACATGGACACCGAGACGGCCTTCATGGAGTT
GAGAGGACTGAGAGTGGACGACACGGCCGTCTATTATTGCGCGAGGGGACCCTCTGGGGAAA
ATTATCCTTTTCACTATTGGGGCCAGGGTGTCCGAGTGGTCGTCTCCGTTCACCCTCCACCAAGGG
CCCATCGGTCTTCCCCCTGGCACCCTCCTCCAAGAGCACCTCTGGGGGCACAGCGGCCCTGGG
CTGCCTGGTCAAGGACTACTTCCCCGAACCGGTGACGGTGTCGTGGAACTCAGGCGCCCTGAC
CAGCGGCGTGCACACCTTCCCGGCTGTCCTACAGTCCTCAGGACTCTACTCCCTCAGCAGCGT
GGTGACCGTGCCCTCCAGCAGCTTGGGCACCCAGACCTACATCTGCAACGTGAATCACAAGCC
CAGCAACACCAAGGTGGACAAGAGAGTTGAGCCCAAATCTTGTGACAAAACTCACACATGCC
CACCGTGCCCAGCACCTGAACTCCTGGGGGGACCGTCAGTCTTCCTCTTCCCCCCAAAACCCA
AGGACACCCTCATGATCTCCCGGACCCCTGAGGTCACATGCGTGGTGGTGGACGTGAGCCACG
AAGACCCTGAGGTCAAGTTCAACTGGTACGTGGACGGCGTGGAGGTGCATAATGCCAAGACA
AAGCCGCGGGAGGAGCAGTACAACAGCACGTACCGGGTGGTCAGCGTCCTCACCGTCCTGCA
CCAGGACTGGCTGAATGGCAAGGAGTACAAGTGCAAGGTCTCCAACAAAGCCCTCCCAGCCC
CCATCGAGAAACCATCTCCAAAGCCAAAGGGCAGCCCCGAGAACCACAGGTGTACACCCTG
CCCCCATCCCGGGAGGAGATGACCAAGAACCAGGTCAGCCTGACCTGCCTGGTCAAAGGCTT
CTATCCCAGCGACATCGCCGTGGAGTGGGAGAGCAATGGGCAGCCGGAGAACAACTACAAGA
CCACGCCTCCCGTGCTGGACTCCGACGGCTCCTTCTTCCTCTACAGCAAGCTCACCGTGGACA
AGAGCAGGTGGCAGCAGGGGAACGTCTTCTCATGCTCCGTGATGCATGAGGCTCTGCACAAC
CACTACACGCAGAAGAGCCTCTCCCTGTCTCCGGGTAAA
SEQ ID NO: 298
```

LIGHT CHAIN

*ASALTQPASMSASPGQSVTISCSGTRHIISAWFQQYPGKPPKLIIF<sup>DDD</sup>KRPSGVPSRFSASRPGDTASLTI
SNVQPEDEATYICNTYEFFGGGTRLTVLS*QPKAAPSVTLFPPSSEELQANKATLVCLI̲SDFYPGAVTV
AWKADS̲SPVKAGVETTT̲PSKQSNNKYAASSYLSLTPEQWKSHRSYSCQ̲VTHEGSTVEK̲TVAPT̲EC
S
SEQ ID NO: 299

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

```
GCATCTGCCCTGACTCAGCCTGCCTCCATGTCTGCGTCCCCTGGACAGTCGGTAACCATCTCGT
GCTCTGGAACCAGACACATAATCTCTGCTTGGTTCCAACAATATCCAGGCAAACCACCCAAAC
TCATAATTTTTGACGACGATAAGCGTCCCTCTGGAGTTCCTAGTCGCTTCTCTGCCTCCAGGCC
TGGCGACACGGCCTCCCTGACAATCTCTAATGTTCAACCTGAGGACGAGGCGACGTACATTTG
CAATACATATGAATTCTTTGGCGGAGGGACCAGATTGACCGTCCTAAGTCAGCCCAAGGCTGC
CCCCTCGGTCACTCTGTTCCCGCCCTCCTCTGAGGAGCTTCAAGCCAACAAGGCCACACTGGT
GTGTCTCATAAGTGACTTCTACCCGGGAGCCGTGACAGTGGCTTGGAAAGCAGATAGCAGCCC
CGTCAAGGCGGGAGTGGAGACCACCACACCCTCCAAACAAAGCAACAACAAGTACGCGGCCA
GCAGCTATCTGAGCCTGACGCCTGAGCAGTGGAAGTCCCACAGAAGCTACAGCTGCCAGGTC
ACGCATGAAGGGAGCACCGTGGAGAAGACAGTGGCCCCTACAGAATGTTCA
SEQ ID NO: 300
```

>N49P9.2
HEAVY CHAIN

*HVQLVQSGGGVKKIGAAVRISCEVTGYKFMDQLINWVRQAPGQGLEWMNPTYGQVNYSWRFEG*
*RVTMTRDMDTETAFMELRGLRVDDTAVYYCARGPSGENYPFHYWGQGVRVVVSS*ASYKGPSNFPLAP
SSKSTSGGTAALGCLVKDYFPEPVTVSWNSGALTSGVHTFPAVLQSSGLYSLSSVVTVPSSSLGTQ
TYICNVNHKPSNTKVDKRVEPKSCDKTHTCPPCPAPELLGGPSVFLFPPKPKDTLMISRTPEVTCVV
VDVSHEDPEVKFNWYVDGVEVHNAKTKPREEQYNSTYRVVSVLTVLHQDWLNGKEYKCKVSN
KALPAPIEKTISKAKGQPREPQVYTLPPSREEMTKNQVSLTCLVKGFYPSDIAVEWESNGQPENNY
KTTPPVLDSDGSFFLYSKLTVDKSRWQQGNVFSCSVMHEALHNHYTQKSLSLSPGK
SEQ ID NO: 301

```
CACGTCCAATTGGTGCAGTCTGGAGGTGGGGTGAAGAAGATTGGGGCCGCTGTGAGGATCTC
CTGCGAGGTGACTGGATATAAATTCATGGACCAACTCATAAACTGGGTGCGGCAGGCCCCCG
GTCAGGGCCTTGAGTGGATGGGATGGATGAATCCAACATATGGACAAGTAAATTATTCATGG
AGATTTGAAGGAAGGGTCACCATGACCAGGGACATGGACACCGAGACGGCCTTCATGGAGTT
GAGAGGACTGAGAGTGGACGACACGGCCGTCTATTATTGCGCGAGGGGACCCTCTGGGGAAA
ATTATCCTTTTCACTATTGGGGCCAGGGTGTCCGAGTGGTCGTCGTCTCATCCTCCACCAAGGG
CCCATCGGTCTTCCCCCTGGCACCCTCCTCCAAGAGCACCTCTGGGGGCACAGCGGCCCTGGG
CTGCCTGGTCAAGGACTACTTCCCCGAACCGGTGACGGTGTCGTGGAACTCAGGCGCCCTGAC
CAGCGGCGTGCACACCTTCCCGGCTGTCCTACAGTCCTCAGGACTCTACTCCCTCAGCAGCGT
GGTGACCGTGCCCTCCAGCAGCTTGGGCACCCAGACCTACATCTGCAACGTGAATCACAAGCC
CAGCAACACCAAGGTGGACAAGAGAGTTGAGCCCAAATCTTGTGACAAAACTCACACATGCC
CACCGTGCCCAGCACCTGAACTCCTGGGGGGACCGTCAGTCTTCCTCTTCCCCCCAAAACCCA
AGGACACCCTCATGATCTCCCGGACCCCTGAGGTCACATGCGTGGTGGTGGACGTGAGCCACG
AAGACCCTGAGGTCAAGTTCAACTGGTACGTGGACGGCGTGGAGGTGCATAATGCCAAGACA
AAGCCGCGGGAGGAGCAGTACAACAGCACGTACCGGGTGGTCAGCGTCCTCACCGTCCTGCA
CCAGGACTGGCTGAATGGCAAGGAGTACAAGTGCAAGGTCTCCAACAAAGCCCTCCCAGCCC
CCATCGAGAAACCATCTCCAAAGCCAAAGGGCAGCCCCGAGAACCACAGGTGTACACCCTG
CCCCCATCCCGGGAGGAGATGACCAAGAACCAGGTCAGCCTGACCTGCCTGGTCAAAGGCTT
CTATCCCAGCGACATCGCCGTGGAGTGGGAGAGCAATGGGCAGCCGGAGAACAACTACAAGA
CCACGCCTCCCGTGCTGGACTCCGACGGCTCCTTCTTCCTCTACAGCAAGCTCACCGTGGACA
AGAGCAGGTGGCAGCAGGGGAACGTCTTCTCATGCTCCGTGATGCATGAGGCTCTGCACAAC
CACTACACGCAGAAGAGCCTCTCCCTGTCTCCGGGTAAA
SEQ ID NO: 302
```

LIGHT CHAIN

*ASALTQPASMSASPGQSVTISCSGTRHIISAWFQQYPGKPPKLIIFDDDKRPSGVPSRFSASRPGDTASLTI*
*SNVQPEDEATYIQNTYEFFGGGTRLTVLGQPKAAPSVTLFPPSSEELQANKATLVCLVSDFYPGAVT*
VAWKADGSPVKVGVETTKPSKQSNNKYAASSYLSLTPEQWKSHRSYSCRVTHEGSTVEKTVAPA
ECS
SEQ ID NO: 303

```
GCATCTGCCCTGACTCAGCCTGCCTCCATGTCTGCGTCCCCTGGACAGTCGGTAACCATCTCGT
GCTCTGGAACCAGACACATAATCTCTGCTTGGTTCCAACAATATCCAGGCAAACCACCCAAAC
TCATAATTTTTGACGACGATAAGCGTCCCTCTGGAGTTCCTAGTCGCTTCTCTGCCTCCAGGCC
TGGCGACACGGCCTCCCTGACAATCTCTAATGTTCAACCTGAGGACGAGGCGACGTACATTTG
CAATACATATGAATTCTTTGGCGGAGGGACCAGATTGACCGTCCTAGGTCAGCCCAAGGCTGC
CCCCTCGGTCACTCTGTTCCCACCCTCCTCTGAGGAGCTTCAAGCCAACAAGGCCACACTGGT
GTGTCTCGTAAGTGACTTCTACCCGGGAGCCGTGACAGTGGCTTGGAAGGCAGATGGCAGCC
CCGTCAAGGTGGGAGTGGAGACCACCAAACCCTCCAAACAAAGCAACAACAAGTATGCGGCC
AGCAGCTACCTGAGCCTGACGCCCGAGCAGTGGAAGTCCCACAGAAGCTACAGCTGCCGGGT
CACGCATGAAGGGAGCACCGTGGAGAAGACAGTGGCCCCTGCAGAATGCTCT
SEQ ID NO: 304
```

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

>N49P9i7
HEAVY CHAIN

*HVQLVQSGGGVKKIGAAVRISCEVTGYKFMDQLINWVRQAPGQGLEWMNPTYGQVNYSWRFEG
RVTMTRDMDTETAFMELRGLRVDDTAVYYCSSTTFWGQGVRVVVSSPSYKGPSVFP*
LAPSSKSTSGGTAALGCLVKDYFPEPVTVSWNSGALTSGVHTFPAVLQSSGLYSLSSVVTVPSSSL
GTQTYICNVNHKPSNTKVDKRVEPKSCDKTHTCPPCPAPELLGGPSVFLFPPKPKDTLMISRTPEVT
CVVVDVSHEDPEVKFNWYVDGVEVHNAKTKPREEQYNSTYRVVSVLTVLHQDWLNGKEYKCK
VSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK
SEQ ID NO: 305

CACGTCCAATTGGTGCAGTCTGGAGGTGGGGTGAAGAAGATTGGGGCCGCTGTGAGGATCTC
CTGCGAGGTGACTGGATATAAATTCATGGACCAACTCATAAACTGGGTGCGGCAGGCCCCCG
GTCAGGGCCTTGAGTGGATGGGATGGATGAATCCAACATATGGACAAGTAAATTATTCATGG
AGATTTGAAGGAAGGGTCACCATGACCAGGGACATGGACACCGAGACGGCCTTCATGGAGTT
GAGAGGACTGAGAGTGGACGACACGGCCGTCTATTATTGCGGAGAGATCGCAGTAATGGAT
CGGGAAAGCGATTCGAGTCCTCCAATTGGGGCCAGGGTGTCCGAGTGGTCGTCTCGTCACCCT
CCACCAAGGGCCCATCGGTCTTCCCCCTGGCACCCTCCTCCAAGAGCACCTCTGGGGGCACAG
CGGCCCTGGGCTGCCTGGTCAAGGACTACTTCCCCGAACCGGTGACGGTGTCGTGGAACTCAG
GCGCCCTGACCAGCGGCGTGCACACCTTCCCGGCTGTCCTACAGTCCTCAGGACTCTACTCCC
TCAGCAGCGTGGTGACCGTGCCCTCCAGCAGCTTGGGCACCCAGACCTACATCTGCAACGTGA
ATCACAAGCCCAGCAACACCAAGGTGGACAAGAGAGTTGAGCCCAAATCTTGTGACAAAACT
CACACATGCCCACCGTGCCCAGCACCTGAACTCCTGGGGGGACCGTCAGTCTTCCTCTTCCCC
CCAAAACCCAAGGACACCCTCATGATCTCCCGGACCCCTGAGGTCACATGCGTGGTGGTGGAC
GTGAGCCACGAAGACCCTGAGGTCAAGTTCAACTGGTACGTGGACGGCGTGGAGGTGCATAA
TGCCAAGACAAAGCCGCGGGAGGAGCAGTACAACAGCACGTACCGGGTGGTCAGCGTCCTCA
CCGTCCTGCACCAGGACTGGCTGAATGGCAAGGAGTACAAGTGCAAGGTCTCCAACAAAGCC
CTCCCAGCCCCCATCGAGAAAACCATCTCCAAAGCCAAAGGGCAGCCCCGAGAACCACAGGT
GTACACCCTGCCCCCATCCCGGGAGGAGATGACCAAGAACCAGGTCAGCCTGACCTGCCTGG
TCAAAGGCTTCTATCCCAGCGACATCGCCGTGGAGTGGGAGAGCAATGGGCAGCCGGAGAAC
AACTACAAGACCACGCCTCCCGTGCTGGACTCCGACGGCTCCTTCTTCCTCTACAGCAAGCTC
ACCGTGGACAAGAGCAGGTGGCAGCAGGGGAACGTCTTCTCATGCTCCGTGATGCATGAGGC
TCTGCACAACCACTACACGCAGAAGAGCCTCTCCCTGTCTCCGGGTAAA
SEQ ID NO: 306

LIGHT CHAIN

*ASALTQPASMSASPGQSVTISCSGTRHIISAWFQQYPGKPPKLIIFDDDKRPSGVPSRFSASRPGDTASLTI
SNVQPEDEATYIQNTYEFFGGGTRLTVLSQPKAAPSVTLFPPSSEELQANKATLVCLVSDFYPGAVTV*
AWKADGSPVKVGVETTKPSKQSNNKYAASSYLSLTPEQWKSHRSYSCRVTHEGSTVEKTVAPAE
CS
SEQ ID NO: 307

GCATCTGCCCTGACTCAGCCTGCCTCCATGTCTGCGTCCCCTGGACAGTCGGTAACCATCTCGT
GCTCTGGAACCAGACACATAATCTCTGCTTGGTTCCAACAATATCCAGGCAAACCACCCAAAC
TCATAATTTTTGACGACGATAAGCGTCCCTCTGGAGTTCCTAGTCGCTTCTCTGCCTCCAGGCC
TGGCGACACGGCCTCCCTGACAATCTCTAATGTTCAACCTGAGGACGAGGCGACGTACATTTG
CAATACATATGAATTCTTTGGCGGAGGGACCAGATTGACCGTCCTAAGTCAGCCCAAGGCTGC
CCCCTCGGTCACTCTGTTCCCACCCTCCTCTGAGGAGCTTCAAGCCAACAAGGCCACACTGGT
GTGTCTCGTAAGTGACTTCTACCCGGGAGCCGTGACAGTGGCCTGGAAGGCAGATGGCAGCC
CCGTCAAGGTGGGAGTGGAGACCACCAAACCCTCCAAACAAAGCAACAACAAGTATGCGGCC
AGCAGCTACCTGAGCCTGACGCCCGAGCAGTGGAAGTCCCACAGAAGCTACAGCTGCCGGGT
CACGCATGAAGGGAGCACCGTGGAGAAGACAGTGGCCCCTGCAGAATGCTCT
SEQ ID NO: 308

>N49P9i7H1
HEAVY CHAIN

*HVQLVQSGGGVKKIGAAVRISCEVTGYKFMDQLINWVRQAPGQGLEWMGMNPTYGQVNYSWRFEG
RVTMTRDMDTETAFMELRGLRVDDTAVYYCVRDRSNGSGKRFESSNWFLDLWGQGVRVVVSSPSYK*
GPSVFPLAPSSKSTSGGTAALGCLVKDYFPEPVTVSWNSGALTSGVHTFPAVLQSSGLYSLSSVVT
VPSSSLGTQTYICNVNHKPSNTKVDKRVEPKSCDKTHTCPPCPAPELLGGPSVFLFPPKPKDTLMIS
RTPEVTCVVVDVSHEDPEVKFNWYVDGVEVHNAKTKPREEQYNSTYRVVSVLTVLHQDWLNGK
EYKCKVSNKALPAPIEKTISKAKGQPREPQVYTLPPSREEMTKNQVSLTCLVKGFYPSDIAVEWES
NGQPENNYKTTPPVLDSDGSFFLYSKLTVDKSRWQQGNVFSCSVMHEALHNHYTQKSLSLSPGK
SEQ ID NO: 309

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

```
CACGTCCAATTGGTGCAGTCTGGAGGTGGGGTGAAGAAGATTGGGGCCGCTGTGAGGATCTC
CTGCGAGGTGACTGGATATAAATTCATGGACCAACTCATAAACTGGGTGCGGCAGGCCCCCG
GTCAGGGCCTTGAGTGGATGGGATGGATGAATCCAACATATGGACAAGTAAATTATTCATGG
AGATTTGAAGGAAGGGTCACCATGACCAGGGACATGGACACCGAGACGGCCTTCATGGAGTT
GAGAGGACTGAGAGTGGACGACACGGCCGTCTATTATTGCGTGAGAGATCGCAGTAATGGAT
CGGGAAAGCGATTCGAGTCCTCCAATTGGTTCCTCGATCTGTGGGGCCAGGGTGTCCGAGTGG
TCGTCTCGTCACCCTCCACCAAGGGCCCATCGGTCTTCCCCCTGGCACCCTCCTCCAAGAGCAC
CTCTGGGGGCACAGCGGCCCTGGGCTGCCTGGTCAAGGACTACTTCCCCGAACCGGTGACGGT
GTCGTGGAACTCAGGCGCCCTGACCAGCGGCGTGCACACCTTCCCGGCTGTCCTACAGTCCTC
AGGACTCTACTCCCTCAGCAGCGTGGTGACCGTGCCCTCCAGCAGCTTGGGCACCCAGACCTA
CATCTGCAACGTGAATCACAAGCCCAGCAACACCAAGGTGGACAAGAGAGTTGAGCCCAAAT
CTTGTGACAAAACTCACACATGCCCACCGTGCCCAGCACCTGAACTCCTGGGGGGACCGTCAG
TCTTCCTCTTCCCCCCAAAACCCAAGGACACCCTCATGATCTCCCGGACCCCTGAGGTCACAT
GCGTGGTGGTGGACGTGAGCCACGAAGACCCTGAGGTCAAGTTCAACTGGTACGTGGACGGC
GTGGAGGTGCATAATGCCAAGACAAAGCCGCGGGAGGAGCAGTACAACAGCACGTACCGGG
TGGTCAGCGTCCTCACCGTCCTGCACCAGGACTGGCTGAATGGCAAGGAGTACAAGTGCAAG
GTCTCCAACAAAGCCCTCCCAGCCCCCATCGAGAAAACCATCTCCAAAGCCAAAGGGCAGCC
CCGAGAACCACAGGTGTACACCCTGCCCCCATCCCGGGAGGAGATGACCAAGAACCAGGTCA
GCCTGACCTGCCTGGTCAAAGGCTTCTATCCCAGCGACATCGCCGTGGAGTGGGAGAGCAATG
GGCAGCCGGAGAACAACTACAAGACCACGCCTCCCGTGCTGGACTCCGACGGCTCCTTCTTCC
TCTACAGCAAGCTCACCGTGGACAAGAGCAGGTGGCAGCAGGGGAACGTCTTCTCATGCTCC
GTGATGCATGAGGCTCTGCACAACCACTACACGCAGAAGAGCCTCTCCCTGTCTCCGGGTAAA
SEQ ID NO: 310
```

LIGHT CHAIN

*ASALTQPASMSASPGQSVTISCSGTRHIISAWFQQYPGKPPKLIIF*<u>DDD</u>*KRPSGVPSRFSASRPGDTASLTI*
*SNVQPEDEATYIQNTYEFF*GGGTRLTVLSQPKAAPSVTLFPPSSEELQANKATLVCLVSDFYPGAVTV
AWKADGSPVKVGVETTKPSKQSNNKYAASSYLSLTPEQWKSHRSYSCRVTHEGSTVEKTVAPAE
CS
SEQ ID NO: 311

```
GCATCTGCCCTGACTCAGCCTGCCTCCATGTCTGCGTCCCCTGGACAGTCGGTAACCATCTCGT
GCTCTGGAACCAGACACATAATCTCTGCTTGGTTCCAACAATATCCAGGCAAACCACCCAAAC
TCATAATTTTTGACGACGATAAGCGTCCCTCTGGAGTTCCTAGTCGCTTCTCTGCCTCCAGGCC
TGGCGACACGGCCTCCCTGACAATCTCTAATGTTCAACCTGAGGACGAGGCGACGTACATTTG
CAATACATATGAATTCTTTGGCGGAGGGACCAGATTGACCGTCCTAAGTCAGCCCAAGGCTGC
CCCCTCGGTCACTCTGTTCCCACCCTCCTCTGAGGAGCTTCAAGCCAACAAGGCCACACTGGT
GTGTCTCGTAAGTGACTTCTACCCGGGAGCCGTGACAGTGGCCTGGAAGGCAGATGGCAGCC
CCGTCAAGGTGGGAGTGGAGACCACCAAACCCTCCAAACAAAGCAACAACAAGTATGCGGCC
AGCAGCTACCTGAGCCTGACGCCCGAGCAGTGGAAGTCCCACAGAAGCTACAGCTGCCGGGT
CACGCATGAAGGGAGCACCGTGGAGAAGACAGTGGCCCCTGCAGAATGCTCT
SEQ ID NO: 312
```

>N49P9i7H2
HEAVY CHAIN

*HVQLVQSGGGVKKIGAAVRISCEVTGYKFMDQLINWVRQAPGQGLEWMNPTYGQVNYSWRFEG*
*RVTMTRDMDTETAFMELRGLRVDDTAVYYCVRDRSNGSGKRFESSNWFLDIWGRGTAVTIQSS*STKG
PSVFPLAPSSKSTSGGTAALGCLVKDYFPEPVTVSWNSGALTSGVHTFPAVLQSSGLYSLSSVVTVP
SSSLGTQTYICNVNHKPSNTKVDKRVEPKSCDKTHTCPPCPAPELLGGPSVFLFPPKPKDTLMISRT
PEVTCVVVDVSHEDPEVKFNWYVDGVEVHNAKTKPREEQYNSTYRVVSVLTVLHQDWLNGKEY
KCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGN<u>VF</u>SCSVMHEALHNHYTQKSLSLSPGK
SEQ ID NO: 313

```
CACGTCCAATTGGTGCAGTCTGGAGGTGGGGTGAAGAAGATTGGGGCCGCTGTGAGGATCTC
CTGCGAGGTGACTGGATATAAATTCATGGACCAACTCATAAACTGGGTGCGGCAGGCCCCCG
GTCAGGGCCTTGAGTGGATGGGATGGATGAATCCAACATATGGACAAGTAAATTATTCATGG
AGATTTGAAGGAAGGGTCACCATGACCAGGGACATGGACACCGAGACGGCCTTCATGGAGTT
GAGAGGACTGAGAGTGGACGACACGGCCGTCTATTATTGCGTGAGAGATCGCAGTAATGGAT
CGGGAAAGCGATTCGAGTCCTCCAATTGGTTCCTCGATCTGTGGGGCCGTGGGACTGCGGTCA
CAATTCAATCATCTCCACCAAGGGCCCATCGGTCTTCCCCCTGGCACCCTCCTCCAAGAGCA
CCTCTGGGGGCACAGCGGCCCTGGGCTGCCTGGTCAAGGACTACTTCCCCGAACCGGTGACGG
TGTCGTGGAACTCAGGCGCCCTGACCAGCGGCGTGCACACCTTCCCGGCTGTCCTACAGTCCT
CAGGACTCTACTCCCTCAGCAGCGTGGTGACCGTGCCCTCCAGCAGCTTGGGCACCCAGACCT
ACATCTGCAACGTGAATCACAAGCCCAGCAACACCAAGGTGGACAAGAGAGTTGAGCCCAAA
TCTTGTGACAAAACTCACACATGCCCACCGTGCCCAGCACCTGAACTCCTGGGGGGACCGTCA
```

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

```
GTCTTCCTCTTCCCCCCAAAACCCAAGGACACCCTCATGATCTCCCGGACCCCTGAGGTCACA
TGCGTGGTGGTGGACGTGAGCCACGAAGACCCTGAGGTCAAGTTCAACTGGTACGTGGACGG
CGTGGAGGTGCATAATGCCAAGACAAAGCCGCGGGAGGAGCAGTACAACAGCACGTACCGG
GTGGTCAGCGTCCTCACCGTCCTGCACCAGGACTGGCTGAATGGCAAGGAGTACAAGTGCAA
GGTCTCCAACAAAGCCCTCCCAGCCCCCATCGAGAAAACCATCTCCAAAGCCAAAGGGCAGC
CCCGAGAACCACAGGTGTACACCCTGCCCCCATCCCGGGAGGAGATGACCAAGAACCAGGTC
AGCCTGACCTGCCTGGTCAAAGGCTTCTATCCCAGCGACATCGCCGTGGAGTGGGAGAGCAAT
GGGCAGCCGGAGAACAACTACAAGACCACGCCTCCCGTGCTGGACTCCGACGGCTCCTTCTTC
CTCTACAGCAAGCTCACCGTGGACAAGAGCAGGTGGCAGCAGGGGAACGTCTTCTCATGCTC
CGTGATGCATGAGGCTCTGCACAACCACTACACGCAGAAGAGCCTCTCCCTGTCTCCGGGTAA
A
SEQ ID NO: 314
```

LIGHT CHAIN

*ASALTQPASMSASPGQSVTISCSGTRHIISAWFQQYPGKPPKLIIFDDDKRPSGVPSRFSASRPGDTASLTI
SNVQPEDEATYIQNTYEFFGGGTRLTVL*RQPKAAPSVTLFPPSSEELQANKATLVCLVSDFYPGAVT
VAWKADGSPVKVGVETTKPSKQSNNKYAASSYLSLTPEQWKSHRSYSCRVTHEGSTVEKTVAPA
ECS
SEQ ID NO: 315

```
GCATCTGCCCTGACTCAGCCTGCCTCCATGTCTGCGTCCCCTGGACAGTCGGTAACCATCTCGT
GCTCTGGAACCAGACACATAATCTCTGCTTGGTTCCAACAATATCCAGGCAAACCACCCAAAC
TCATAATTTTTGACGACGATAAGCGTCCCTCTGGAGTTCCTAGTCGCTTCTCTGCCTCCAGGCC
TGGCGACACGGCCTCCCTGACAATCTCTAATGTTCAACCTGAGGACGAGGCGACGTACATTTG
CAATACATATGAATTCTTTGGCGGAGGGACCAGATTGACCGTCCTACGTCAGCCCAAGGCTGC
CCCCTCGGTCACTCTGTTCCCACCCTCCTCTGAGGAGCTTCAAGCCAACAAGGCCACACTGGT
GTGTCTCGTAAGTGACTTCTACCCGGGAGCCGTGACAGTGGCCTGGAAGGCAGATGGCAGCC
CCGTCAAGGTGGGAGTGGAGACCACCAAACCCTCCAAACAAAGCAACAACAAGTATGCGGCC
AGCAGCTACCTGAGCCTGACGCCCGAGCAGTGGAAGTCCACAGAAGCTACAGCTGCCGGGT
CACGCATGAAGGGAGCACCGTGGAGAAGACAGTGGCCCCTGCAGAATGCTCT
SEQ ID NO: 316
```

>N49P22
HEAVY CHAIN

*HIQLLQSGPQVKKSGDTVRISCETSGYNFVDSRIHWVRQTPEKRLRWMGWINPLQGGVNYAPEFQGRI
RMTRDTFIDTVYVDLSGLTPADTAYYYCARGIDGKSYPFHFWGHGTFRVTVFSAS*TKGPSNFPLAPSSKS
TSGGTAALGCLVKDYFPEPVTVSWNSGALTSGVHTFPAVLQSSGLYSLSSVVTVPSSSLGTQTYIC
NVNHKPSNTKVDKRVEPKSCDKTHTCPPCPAPELLGGPSVFLFPPKPKDTLMISRTPEVTCVVVDV
SHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPP
VLDSDGSFFLYSKLTVDKSRWQQGNVFSCSVMHEALHNHYTQKSLSLSPGK
SEQ ID NO: 317

```
CACATTCAGTTGCTACAGTCGGGGCCTCAAGTTAAGAAGTCTGGGGACACAGTGAGAATCTCC
TGTGAGACCTCTGGATATAACTTCGTCGACTCCCGTATCCACTGGGTCCGACAGACCCCGGAA
AAACGTCTCAGATGGATGGGCTGGATCAATCCTCTCCAAGGTGGTGTGAATTACGCGCCGGAA
TTTCAGGGCAGAATCAGGATGACCAGGGACACATTTATAGACACAGTTTACGTGGACCTGAG
CGGACTGACACCGGCCGACACGGCCTATTATTACTGCGCGCGAGGGATCGATGGCAAGTCTTA
CCCCTTTCATTTCTGGGGCCACGGAACCCGGGTCACCGTCTTCTCGGCCTCCACCAAGGGCCC
ATCGGTCTTCCCCCTGGCACCCTCCTCCAAGAGCACCTCTGGGGGCACAGCGGCCCTGGGCTG
CCTGGTCAAGGACTACTTCCCCGAACCGGTGACGGTGTCGTGGAACTCAGGCGCCCTGACCAG
CGGCGTGCACACCTTCCCGGCTGTCCTACAGTCCTCAGGACTCTACTCCCTCAGCAGCGTGGT
GACCGTGCCCTCCAGCAGCTTGGGCACCCAGACCTACATCTGCAACGTGAATCACAAGCCCAG
CAACACCAAGGTGGACAAGAGAGTTGAGCCCAAATCTTGTGACAAAACTCACACATGCCCAC
CGTGCCCAGCACCTGAACTCCTGGGGGGACCGTCAGTCTTCCTCTTCCCCCCAAAACCCAAGG
ACACCCTCATGATCTCCCGGACCCCTGAGGTCACATGCGTGGTGGTGGACGTGAGCCACGAAG
ACCCTGAGGTCAAGTTCAACTGGTACGTGGACGGCGTGGAGGTGCATAATGCCAAGACAAAG
CCGCGGGAGGAGCAGTACAACAGCACGTACCGGGTGGTCAGCGTCCTCACCGTCCTGCACCA
GGACTGGCTGAATGGCAAGGAGTACAAGTGCAAGGTCTCCAACAAAGCCCTCCCAGCCCCCA
TCGAGAAAACCATCTCCAAAGCCAAAGGGCAGCCCCGAGAACCACAGGTGTACACCCTGCCC
CCATCCCGGGAGGAGATGACCAAGAACCAGGTCAGCCTGACCTGCCTGGTCAAAGGCTTCTA
TCCCAGCGACATCGCCGTGGAGTGGGAGAGCAATGGGCAGCCGGAGAACAACTACAAGACCA
CGCCTCCCGTGCTGGACTCCGACGGCTCCTTCTTCCTCTACAGCAAGCTCACCGTGGACAAGA
GCAGGTGGCAGCAGGGGAACGTCTTCTCATGCTCCGTGATGCATGAGGCTCTGCACAACCACT
ACACGCAGAAGAGCCTCTCCCTGTCTCCGGGTAAA
SEQ ID NO: 318
```

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

LIGHT CHAIN

*RFALTQPASVSGSPGQTITITCAGGSVSWFHFPPGKTPRLIIYESSKRPSGVSPRFSGSQSGSTASLIISGLQ*
*SDDEGTYFCSILEFFGRGTLVTVLSQP*KAAPSVTLFPPSSEELQANKATLVCLVSDFYPGAVTVAWK
ADGSPVKVGVETTKPSKQSNNKYAASSYLSLTPEQWKSHRSYSCRVTHEGSTVEKTVAPAECS
SEQ ID NO: 319

CGATTTGCCCTGACTCAACCTGCCTCCGTGTCTGGGTCTCCTGGACAGACGATCACCATAACCT
GCGCTGGAGGCAGCGTCTCCTGGTTTCATTTCCCTCCAGGCAAAACCCCAGACTCATTATTTA
TGAGTCTTCTAAGCGACCCTCTGGGGTCTCTCCTCGATTCTCTGGGTCCCAGTCTGGCAGCACG
GCCTCCCTTATAATTTCTGGCCTCCAGTCTGATGACGAAGGGACATACTTCTGTTCTATTCTTG
AATTTTTCGGCAGAGGGACTCTTGTCACCGTCCTGAGTCAGCCCAAGGCTGCCCCCTCGGTCA
CTCTGTTCCCACCCTCCTCTGAGGAGCTTCAAGCCAACAAGGCCACACTGGTGTGTCTCGTAA
GTGACTTCTACCCGGGAGCCGTGACAGTGGCCTGGAAGGCAGATGGCAGCCCCGTCAAGGTG
GGAGTGGAGACCACCAAACCCTCCAAACAAAGCAACAACAAGTATGCGGCCAGCAGCTACCT
GAGCCTGACGCCCGAGCAGTGGAAGTCCCACAGAAGCTACAGCTGCCGGGTCACGCATGAAG
GGAGCACCGTGGAGAAGACAGTGGCCCCTGCAGAATGCTCT
SEQ ID NO: 320

>N49P23
HEAVY CHAIN

*QVRLVQSGAGARKTGASMKLSCSTSGYTFTTTHHGHF*INWVRQARGQGLEWMGWMNPMTGQMNIEG*
*KFQGRVTLTRDIYSDTAYMEMTRLTTGDTGTYYCARGDFGQNYPFHYWGQGSLVIVSS*ASTKGPSVFP
LAPSSKSTSGGTAALGCLVKDYFPEPVTVSWNSGALTSGVHTFPAVLQSSGLYSLSSVVTVPSSSL
GTQTYICNVNHKPSNTKVDKRVEPKSCDKTHTCPPCPAPELLGGPSVFLFPPKPKDTLMISRTPEVT
CVVVDVSHEDPEVKFNWYVDG̲VEVHNAKTKPREEQYNSTYRVVSVLTVLHQDWLNGKEYKCK
VSNKALPAPIEKTISKAKGQPREPQVYTLPPSREE̲MTKNQVSLTCLVKGFYPSDIAVEWESNGQPE
NNYKTTPPVLDSDGSFFLYSKLTVDKSRWQQGNV̲FS̲CSVMHEALHNHYTQKSLSLSPGK
SEQ ID NO: 321

CAGGTGCGCTTGGTGCAGTCTGGGGCTGGGGCGAGGAAGACTGGGGCCTCAATGAAACTTTC
CTGCTCGACCTCTGGATACACCTTCACCACTCATCACGGCCACTTCATAAATTGGGTGCGACA
GGCCCGTGGACAAGGGCTTGAGTGGATGGGGTGGATGAATCCCATGACTGGGCAGATGAATA
TTGAGGGGAAATTTCAGGGCAGAGTCACCCTCACTCGAGACATATACAGTGACACGGCTTAC
ATGGAAATGACCAGACTGACAACTGGCGACACGGGCACTTATTACTGTGCGCGAGGCGATTT
CGGACAGAATTATCCCTTTCATTATTGGGGCCAGGGAAGCCTGGTCATCGTCTCCTCGGCCTC
CACCAAGGGCCCATCGGTCTTCCCCCTGGCACCCTCCTCCAAGAGCACCTCTGGGGGCACAGC
GGCCCTGGGCTGCCTGGTCAAGGACTACTTCCCCGAACCGGTGACGGTGTCGTGGAACTCAGG
CGCCCTGACCAGCGGCGTGCACACCTTCCCGGCTGTCCTACAGTCCTCAGGACTCTACTCCCTC
AGCAGCGTGGTGACCGTGCCCTCCAGCAGCTTGGGCACCCAGACCTACATCTGCAACGTGAAT
CACAAGCCCAGCAACACCAAGGTGGACAAGAGAGTTGAGCCCAAATCTTGTGACAAAACTCA
CACATGCCCACCGTGCCCAGCACCTGAACTCCTGGGGGGACCGTCAGTCTTCCTCTTCCCCCC
AAAACCCAAGGACACCCTCATGATCTCCCGGACCCCTGAGGTCACATGCGTGGTGGTGGACGT
GAGCCACGAAGACCCTGAGGTCAAGTTCAACTGGTACGTGGACGGCGTGGAGGTGCATAATG
CCAAGACAAAGCCGCGGGAGGAGCAGTACAACAGCACGTACCGGGTGGTCAGCGTCCTCACC
GTCCTGCACCAGGACTGGCTGAATGGCAAGGAGTACAAGTGCAAGGTCTCCAACAAAGCCCT
CCCAGCCCCCATCGAGAAAACCATCTCCAAAGCCAAAGGGCAGCCCCGAGAACCACAGGTGT
ACACCCTGCCCCCATCCCGGGAGGAGATGACCAAGAACCAGGTCAGCCTGACCTGCCTGGTC
AAAGGCTTCTATCCCAGCGACATCGCCGTGGAGTGGGAGAGCAATGGGCAGCCGGAGAACAA
CTACAAGACCACGCCTCCCGTGCTGGACTCCGACGGCTCCTTCTTCCTCTACAGCAAGCTCAC
CGTGGACAAGAGCAGGTGGCAGCAGGGGAACGTCTTCTCATGCTCCGTGATGCATGAGGCTC
TGCACAACCACTACACGCAGAAGAGCCTCTCCCTGTCTCCGGGTAAA
SEQ ID NO: 322

LIGHT CHAIN

*LSALTQPASVSGSPGQSVTISCSGTNRYLVSWYQQHPDKAPKLIIYDDNKRPSGISDRFSASRPDDTASLTI*
*SGLQTGDEATYWCASYERFGGGTRLTVLSQP*KAAPSVTLFPPSSEELQANKATLVCLVSDFYPGAVT
VAWKADGSPVKVGVETTKPSKQSNNKYAASSYLSLTPEQWKSHRSYSCRVTHEGSTVEKTVAPA
ECS
SEQ ID NO: 323

CTGTCTGCCCTGACTCAGCCTGCCTCCGTGTCTGGGTCTCCTGGGCAGTCGGTCACCATCTCCT
GCTCTGGAACGAACCGTTACCTTGTCTCCTGGTATCAACAACACCCTGACAAAGCCCCCAAAC
TCATCATTTATGACGACAATAAGCGGCCCTCAGGAATTTCTGATCGCTTCTCAGCCTCCAGGC
CTGACGACACGGCCTCCCTGACAATCTCTGGACTCCAGACTGGGGACGAGGCTACTTATTGGT

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

```
GTGCCTCATATGAACGTTTTGGCGGCGGGACGAGGCTGACCGTCCTTAGTCAGCCCAAGGCTG
CCCCCTCGGTCACTCTGTTCCCACCCTCCTCTGAGGAGCTTCAAGCCAACAAGGCCACACTGG
TGTGTCTCGTAAGTGACTTCTACCCGGGAGCCGTGACAGTGGCCTGGAAGGCAGATGGCAGCC
CCGTCAAGGTGGGAGTGGAGACCACCAAACCCTCCAAACAAAGCAACAACAAGTATGCGGCC
AGCAGCTACCTGAGCCTGACGCCCGAGCAGTGGAAGTCCCACAGAAGCTACAGCTGCCGGGT
CACGCATGAAGGGAGCACCGTGGAGAAGACAGTGGCCCCTGCAGAATGCTCT
SEQ ID NO: 324
```

>N49P9.3
HEAVY CHAIN

```
HVQLVQSGGGVKKIGAAVRISCEVS*GYNFMDQFINWVRQAPGQGLEWMGWMNPIYGQVNYSWRFQG
RVTMTRDMYTDTAFMELRGLRVDDTAVYYCARGPSGENYPFHYWGQGVRVVVSS*PSTKGPSNFPLAP
SSKSTSGGTAALGCLVKDYFPEPVTVSWNSGALTSGVHTFPAVLQSSGLYSLSSVVTVPSSSLGTQ
TYICNVNHKPSNTKVDKRVEPKSCDKTHTCPPCPAPELLGGPSVFLFPPKPKDTLMISRTPEVTCVV
VDVSHEDPEVKFNWYVDGVEVHNAKTKPREEQYNSTYRVVSVLTVLHQDWLNGKEYKCKVSN
KALPAPIEKTISKAKGQPREPQVYTLPPSREEMTKNQVSLTCLVKGFYPSDIAVEWESNGQPENNY
KTTPPVLDSDGSFFLYSKLTVDKSRWQQGNVFSCSVMHEALHNHYTQKSLSLSPGK
SEQ ID NO: 325
```

```
CACGTCCAATTGGTGCAGTCTGGAGGTGGGGTGAAGAAGATTGGGGCCGCTGTGAGGATCTC
CTGCGAGGTGTCTGGATACAACTTCATGGACCAATTCATAAATTGGGTGCGACAGGCCCCGG
TCAGGGCCTTGAGTGGATGGGATGGATGAACCCAATATATGGACAAGTAAATTATTCATGGA
GATTTCAAGGAAGGGTCACCATGACCAGGGACATGTACACCGACACGGCCTTCATGGAGTTG
AGAGGACTGAGAGTGGACGACACGGCCGTCTATTATTGCGCGAGGGGACCCTCTGGGGAAAA
TTATCCTTTTCACTATTGGGGCCAGGGTGTCCGAGTGGTCGTCTCGTCACCCTCCACCAAGGGC
CCATCGGTCTTCCCCCTGGCACCCTCCTCCAAGAGCACCTCTGGGGGCACAGCGGCCCTGGGC
TGCCTGGTCAAGGACTACTTCCCCGAACCGGTGACGGTGTCGTGGAACTCAGGCGCCCTGACC
AGCGGCGTGCACACCTTCCCGGCTGTCCTACAGTCCTCAGGACTCTACTCCCTCAGCAGCGTG
GTGACCGTGCCCTCCAGCAGCTTGGGCACCCAGACCTACATCTGCAACGTGAATCACAAGCCC
AGCAACACCAAGGTGGACAAGAGAGTTGAGCCCAAATCTTGTGACAAAACTCACACATGCCC
ACCGTGCCCAGCACCTGAACTCCTGGGGGGACCGTCAGTCTTCCTCTTCCCCCCAAAACCCAA
GGACACCCTCATGATCTCCCGGACCCCTGAGGTCACATGCGTGGTGGTGGACGTGAGCCACGA
AGACCCTGAGGTCAAGTTCAACTGGTACGTGGACGGCGTGGAGGTGCATAATGCCAAGACAA
AGCCGCGGGAGGAGCAGTACAACAGCACGTACCGGGTGGTCAGCGTCCTCACCGTCCTGCAC
CAGGACTGGCTGAATGGCAAGGAGTACAAGTGCAAGGTCTCCAACAAAGCCCTCCCAGCCCC
CATCGAGAAAACCATCTCCAAAGCCAAAGGGCAGCCCCGAGAACCACAGGTGTACACCCTGC
CCCCATCCCGGGAGGAGATGACCAAGAACCAGGTCAGCCTGACCTGCCTGGTCAAAGGCTTC
TATCCCAGCGACATCGCCGTGGAGTGGGAGAGCAATGGGCAGCCGGAGAACAACTACAAGAC
CACGCCTCCCGTGCTGGACTCCGACGGCTCCTTCTTCCTCTACAGCAAGCTCACCGTGGACAA
GAGCAGGTGGCAGCAGGGGAACGTCTTCTCATGCTCCGTGATGCATGAGGCTCTGCACAACC
ACTACACGCAGAAGAGCCTCTCCCTGTCTCCGGGTAAA
SEQ ID NO: 326
```

LIGHT CHAIN

```
ASALTQPASMSASPGQSVTISCSGTRHIISAWFQQYPGKPPKLIIFDDDKRPSGVPSRFSASRPGDTASLTI
SNVQPEDEATYICNTYEFFGGGTKLTVLRQPKAAPSVTLFPPSSEELQANKATLVCLVSDFYPGAVT
VAWKADGSPVKVGVETTKPSKQSNNKYAASSYLSLTPEQWKSHRSYSCRVTHEGSTVEKTVAPA
ECS
SEQ ID NO: 327
```

```
GCATCTGCCCTGACTCAGCCTGCCTCCATGTCTGCGTCCCCTGGACAGTCGGTAACCATCTCGT
GCTCTGGAACCAGACACATAATCTCTGCTTGGTTCCAACAATATCCAGGCAAACCACCCAAAC
TCATAATTTTTGACGACGATAAGCGTCCCTCTGGAGTTCCTAGTCGCTTCTCTGCCTCCAGGCC
TGGCGACACGGCCTCCCTGACAATCTCTAATGTTCAACCTGAGGACGAGGCGACATACATTTG
CAATACATATGAATTCTTTGGCGGAGGGACCAAATTGACCGTCCTACGTCAGCCCAAGGCTGC
CCCCTCGGTCACTCTGTTCCCACCCTCCTCTGAGGAGCTTCAAGCCAACAAGGCCACACTGGT
GTGTCTCGTAAGTGACTTCTACCCGGGAGCCGTGACAGTGGCCTGGAAGGCAGATGGCAGCC
CCGTCAAGGTGGGAGTGGAGACCACCAAACCCTCCAAACAAAGCAACAACAAGTATGCGGCC
AGCAGCTACCTGAGCCTGACGCCCGAGCAGTGGAAGTCCCACAGAAGCTACAGCTGCCGGGT
CACGCATGAAGGGAGCACCGTGGAGAAGACAGTGGCCCCTGCAGAATGCTCT
SEQ ID NO: 328
```

>N49P9.4
HEAVY CHAIN

*HVQLVQSGGGVKKIGAAVRISCEVS*GYNFMDQFINWVRQAPGQGLEWMGWMNPIYGQVNYSWRFQG*

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

*RVTMTRDMYTDTAFMELRGLRVDDTAVYYCRGPSGENYPFHYWGQGVRVVVSS*PSTKGPSNFPLAP
SSKSTSGGTAALGCLVKDYFPEPVTVSWNSGALTSGVHTFPAVLQSSGLYSLSSVVTVPSSSLGTQ
TYICNVNHKPSNTKVDKRVEPKSCDKTHTCPPCPAPELLGGPSVFLPPKPKDTLMISRTPEVTCVV
VDVSHEDPEVKFNWYVDGVEVHNAKTKPREEQYNSTYRVVSVLTVLHQDWLNGKEYKCKVSN
KALPAPIEKTISKAKGQPREPQVYTLPPSREEMTKNQVSLTCLVKGFYPSDIAVEWESNGQPENNY
KTTPPVLDSDGSFFLYSKLTVDKSRWQQGNVFSCSVMHEALHNHYTQKSLSLSPGK
SEQ ID NO: 329

```
CACGTCCAATTGGTGCAGTCTGGAGGTGGGGTGAAGAAGATTGGGGCCGCTGTGAGGATCTC
CTGCGAGGTGTCTGGATACAACTTCATGGACCAATTCATAAATTGGGTGCGACAGGCCCCCGG
TCAGGGCCTTGAGTGGATGGGATGGATGAACCCAATATATGGACAAGTAAATTATTCATGGA
GATTTCAAGGAAGGGTCACCATGACCAGGGACATGTACACCGACACGGCCTTCATGGAGTTG
AGAGGACTGAGAGTGGACGACACGGCCGTCTATTATTGCGCGAGGGGACCCTCTGGGGAAAA
TTATCCTTTTCACTATTGGGGCCAGGGTGTCCGAGTGGTCGTCTCGTCACCCTCCACCAAGGGC
CCATCGGTCTTCCCCCTGGCACCCTCCTCCAAGAGCACCTCTGGGGGCACAGCGGCCCTGGGC
TGCCTGGTCAAGGACTACTTCCCCGAACCGGTGACGGTGTCGTGGAACTCAGGCGCCCTGACC
AGCGGCGTGCACACCTTCCCGGCTGTCCTACAGTCCTCAGGACTCTACTCCCTCAGCAGCGTG
GTGACCGTGCCCTCCAGCAGCTTGGGCACCCAGACCTACATCTGCAACGTGAATCACAAGCCC
AGCAACACCAAGGTGGACAAGAGAGTTGAGCCCAAATCTTGTGACAAAACTCACACATGCCC
ACCGTGCCCAGCACCTGAACTCCTGGGGGGACCGTCAGTCTTCCTCTTCCCCCCAAAACCCAA
GGACACCCTCATGATCTCCCGGACCCCTGAGGTCACATGCGTGGTGGTGGACGTGAGCCACGA
AGACCCTGAGGTCAAGTTCAACTGGTACGTGGACGGCGTGGAGGTGCATAATGCCAAGACAA
AGCCGCGGGAGGAGCAGTACAACAGCACGTACCGGGTGGTCAGCGTCCTCACCGTCCTGCAC
CAGGACTGGCTGAATGGCAAGGAGTACAAGTGCAAGGTCTCCAACAAAGCCCTCCCAGCCCC
CATCGAGAAAACCATCTCCAAAGCCAAAGGGCAGCCCCGAGAACCACAGGTGTACACCCTGC
CCCCATCCCGGGAGGAGATGACCAAGAACCAGGTCAGCCTGACCTGCCTGGTCAAAGGCTTC
TATCCCAGCGACATCGCCGTGGAGTGGGAGAGCAATGGGCAGCCGGAGAACAACTACAAGAC
CACGCCTCCCGTGCTGGACTCCGACGGCTCCTTCTTCCTCTACAGCAAGCTCACCGTGGACAA
GAGCAGGTGGCAGCAGGGGAACGTCTTCTCATGCTCCGTGATGCATGAGGCTCTGCACAACC
ACTACACGCAGAAGAGCCTCTCCCTGTCTCCGGGTAAA
SEQ ID NO: 330
```

LIGHT CHAIN

*ASALTQPASMSASPGQSVTISCSGTRHIISAWFQQYPGKPPKLIIF*DDD*KRPSGVPSRFSASRPGDTASLTI
SNVQPEDEATYICNTYEFFGGGTKLTVLS*QPKAAPSVTLFPPSSEELQANKATLVCLVSDFYPGAVTV
AWKADGSPVKVGVETTKPSKQSNNKYAASSYLSLTPEQWKSHRSYSCRVTHEGSTVEKTVAPAE
CS
SEQ ID NO: 331

```
GCATCTGCCCTGACTCAGCCTGCCTCCATGTCTGCGTCCCCTGGACAGTCGGTAACCATCTCGT
GCTCTGGAACCAGACACATAATCTCTGCTTGGTTCCAACAATATCCAGGCAACCACCCAAAC
TCATAATTTTTGACGACGATAAGCGTCCCTCTGGAGTTCCTAGTCGCTTTCTCTGCCTCCAGGCC
TGGCGACACGGCCTCCCTGACAATCTCTAATGTTCAACCTGAGGACGAGGCGACATACATTTG
CAATACATATGAATTCTTTGGCGGAGGGACCAAATTGACCGTCCTAAGTCAGCCCAAGGCTGC
CCCCTCGGTCACTCTGTTCCCACCCTCCTCTGAGGAGCTTCAAGCCAACAAGGCCACACTGGT
GTGTCTCGTAAGTGACTTCTACCCGGGAGCCGTGACAGTGGCCTGGAAGGCAGATGGCAGCC
CCGTCAAGGTGGGAGTGGAGACCACCAAACCCTCCAAACAAAGCAACAACAAGTATGCGGCC
AGCAGCTACCTGAGCCTGACGCCCGAGCAGTGGAAGTCCCACAGAAGCTACAGCTGCCGGGT
CACGCATGAAGGGAGCACCGTGGAGAAGACAGTGGCCCCTGCAGAATGCTCT
SEQ ID NO: 332
```

>N49P51
HEAVY CHAIN

*HIQLLQSGPQVKKSGDTVRISCETSGYNFVDSRIHWVRQTPEKRLRWMGWINPLHGGVNYAPEFQGRI
RMTRDTFIDTVYVDLSGLTPADTAYYYCRGIDGKSYPFHFWGHGTRVTVFS*ASTKGPSVFPLAPSSKS
TSGGTAALGCLVKDYFPEPVTVSWNSGALTSGVHTFPAVLQSSGLYSLSSVVTVPSSSLGTQTYIC
NVNHKPSNTKVDKRVEPKSCDKTHTCPPCPAPELLGGPSVFLPPKPKDTLMISRTPEVTCVVVDV
SHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPP
VLDSDGSFFLYSKLTVDKSRWQQGNVFSCSVMHEALHNHYTQKSLSLSPGK
SEQ ID NO: 333

```
CACATTCAGTTGCTACAGTCGGGGCCTCAAGTTAAGAAGTCTGGGGACACAGTGAGAATCTCC
TGTGAGACCTCTGGATATAACTTCGTCGACTCCCGTATCCACTGGGTCCGACAGACCCCGGAA
AAACGTCTCAGATGGATGGGCTGGATCAATCCTCTCCACGGTGGTGTGAATTACGCGCCGGAA
TTTCAGGGCAGAATCAGGATGACCAGGGACACATTTATAGACACAGTTTACGTGGACCTGAG
```

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

```
CGGACTGACACCGGCCGACACGGCCTATTATTACTGCGCGCGAGGGATCGATGGCAAGTCTTA
CCCCTTTCATTTCTGGGGCCACGGAACCCGGGTCACCGTCTTCTCGGCCTCCACCAAGGGCCC
ATCGGTCTTCCCCCTGGCACCCTCCTCCAAGAGCACCTCTGGGGGCACAGCGGCCCTGGGCTG
CCTGGTCAAGGACTACTTCCCCGAACCGGTGACGGTGTCGTGGAACTCAGGCGCCCTGACCAG
CGGCGTGCACACCTTCCCGGCTGTCCTACAGTCCTCAGGACTCTACTCCCTCAGCAGCGTGGT
GACCGTGCCCTCCAGCAGCTTGGGCACCCAGACCTACATCTGCAACGTGAATCACAAGCCCAG
CAACACCAAGGTGGACAAGAGAGTTGAGCCCAAATCTTGTGACAAAACTCACACATGCCCAC
CGTGCCCAGCACCTGAACTCCTGGGGGACCGTCAGTCTTCCTCTTCCCCCCAAAACCCAAGG
ACACCCTCATGATCTCCCGGACCCCTGAGGTCACATGCGTGGTGGACGTGAGCCACGAAG
ACCCTGAGGTCAAGTTCAACTGGTACGTGGACGGCGTGGAGGTGCATAATGCCAAGACAAAG
CCGCGGGAGGAGCAGTACAACAGCACGTACCGGGTGGTCAGCGTCCTCACCGTCCTGCACCA
GGACTGGCTGAATGGCAAGGAGTACAAGTGCAAGGTCTCCAACAAAGCCCTCCCAGCCCCCA
TCGAGAAAACCATCTCCAAAGCCAAAGGGCAGCCCCGAGAACCACAGGTGTACACCCTGCCC
CCATCCCGGGAGGAGATGACCAAGAACCAGGTCAGCCTGACCTGCCTGGTCAAAGGCTTCTA
TCCCAGCGACATCGCCGTGGAGTGGGAGAGCAATGGGCAGCCGGAGAACAACTACAAGACCA
CGCCTCCCGTGCTGGACTCCGACGGCTCCTTCTTCCTCTACAGCAAGCTCACCGTGGACAAGA
GCAGGTGGCAGCAGGGGAACGTCTTCTCATGCTCCGTGATGCATGAGGCTCTGCACAACCACT
ACACGCAGAAGAGCCTCTCCCTGTCTCCGGGTAAA
SEQ ID NO: 334
```

LIGHT CHAIN

*RFALTQPASVSGSPGQTITITCAGGSVSWFHFPPGKTPRLIIYESSKRPSGVSPRFSGSQSGSTASLIISGLQ
SDDEGTYFCSILEFFGRGTLVTVLSQPKAAPSVTLFPPSSEELQANKATLVCLVSDFYPGAVTVAWK*
ADGSPVKVGVETTKPSKQSNNKYAASSYLSLTPEQWKSHRSYSCRVTHEGSTVEKTVAPAECS
SEQ ID NO: 335

```
CGATTTGCCCTGACTCAACCTGCCTCCGTGTCTGGGTCTCCTGGACAGACGATCACCATAACCT
GCGCTGGAGGCAGCGTCTCCTGGTTTCATTTCCCTCCAGGCAAAACCCCCAGACTCATTATTTA
TGAGTCTTCTAAGCGACCCTCTGGGGTCTCTCCTCGATTCTCTGGGTCCCAGTCTGGCAGCACG
GCCTCCCTCATAATTTCTGGCCTCCAGTCTGATGACGAAGGGACATACTTCTGTTCTATTCTTG
AATTTTTCGGCAGAGGGACTCTTGTCACCGTCCTGAGTCAGCCCAAGGCTGCCCCCTCGGTCA
CTCTGTTCCCACCCTCCTCTGAGGAGCTTCAAGCCAACAAGGCCACACTGGTGTGTCTCGTAA
GTGACTTCTACCCGGGAGCCGTGACAGTGGCCTGGAAGGCAGATGGCAGCCCCGTCAAGGTG
GGAGTGGAGACCACCAAACCCTCCAAACAAAGCAACAACAAGTATGCGGCCAGCAGCTACCT
GAGCCTGACGCCCGAGCAGTGGAAGTCCCACAGAAGCTACAGCTGCCGGGTCACGCATGAAG
GGAGCACCGTGGAGAAGACAGTGGCCCCTGCAGAATGCTCT
SEQ ID NO: 336
```

>N49P52
HEAVY CHAIN

*RVTLQQSGAIVRQPGASVTVSCETSGYTFTKYFIYWVRQAPGQGLEWLGRIHPRTGAVKYAPRFQGRLS
MTRDWSLDTAYLGLTGLTLGDTALYFCARGAFEADSYGSSYPFHHWGQGTLVTVSA*ASTKGPSVFPL
APSSKSTSGGTAALGCLVKDYFPEPVTVSWNSGALTSGVHTFPAVLQSSGLYSLSSVVTVPSSSLG
TQTYICNVNHKPSNTKVDKRVEPKSCDKTHTCPPCPAPELLGGPSVFLFPPKPKDTLMISRTPEVTC
VVVDVSHEDPEVKFNWYVDG̅VEVHNAKTKPREEQYNSTYRVVSVLTVLHQDWLNGKEYKCKV
SNKALPAPIEKTISKAKGQPREPQVYTLPPSREEMTKNQVSLTCLVKGFYPSDIAVEWESNGQPEN
NYKTTPPVLDSDGSFFLYSKLTVDKSRWQQGNV̅F̅SCSVMHEALHNHYTQKSLSLSPGK
SEQ ID NO: 337

```
CGTGTTACATTACAACAATCTGGGGCTATAGTGAGGCAGCCTGGGGCCTCAGTGACCGTCTCC
TGCGAGACTTCTGGATATACTTTCACCAAGTATTTCATCTACTGGGTGCGACAGGCCCCTGGA
CAGGGTCTTGAGTGGCTGGGCAGAATACACCCCCGAACCGGTGCCGTGAAGTATGCACCGAG
ATTTCAGGGTAGACTGTCCATGACCAGAGACTGGTCACTCGACACAGCCTACCTCGGATTGAC
CGGACTGACACTCGGCGACACGGCTCTATATTTCTGTGCGAGGGGGGCCTTTGAGGCAGATTC
ATATGGGTCAAGTTATCCCTTTCACCACTGGGGCAGGGAACCCTAGTCACCGTCTCCGCGGC
CTCCACCAAGGGCCCATCGGTCTTCCCCCTGGCACCCTCCTCCAAGAGCACCTCTGGGGGCAC
AGCGGCCCTGGGCTGCCTGGTCAAGGACTACTTCCCCGAACCGGTGACGGTGTCGTGGAACTC
AGGCGCCCTGACCAGCGGCGTGCACACCTTCCCGGCTGTCCTACAGTCCTCAGGACTCTACTC
CCTCAGCAGCGTGGTGACCGTGCCCTCCAGCAGCTTGGGCACCCAGACCTACATCTGCAACGT
GAATCACAAGCCCAGCAACACCAAGGTGGACAAGAGAGTTGAGCCCAAATCTTGTGACAAAA
CTCACACATGCCCACCGTGCCCAGCACCTGAACTCCTGGGGGGACCGTCAGTCTTCCTCTTCC
CCCCAAAACCCAAGGACACCCTCATGATCTCCCGGACCCCTGAGGTCACATGCGTGGTGGTGG
ACGTGAGCCACGAAGACCCTGAGGTCAAGTTCAACTGGTACGTGGACGGCGTGGAGGTGCAT
AATGCCAAGACAAAGCCGCGGGAGGAGCAGTACAACAGCACGTACCGGGTGGTCAGCGTCCT
CACCGTCCTGCACCAGGACTGGCTGAATGGCAAGGAGTACAAGTGCAAGGTCTCCAACAAAG
CCCTCCCAGCCCCCATCGAGAAAACCATCTCCAAAGCCAAAGGGCAGCCCCGAGAACCACAG
```

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

```
GTGTACACCCTGCCCCCATCCCGGGAGGAGATGACCAAGAACCAGGTCAGCCTGACCTGCCT
GGTCAAAGGCTTCTATCCCAGCGACATCGCCGTGGAGTGGGAGAGCAATGGGCAGCCGGAGA
ACAACTACAAGACCACGCCTCCCGTGCTGGACTCCGACGGCTCCTTCTTCCTCTACAGCAAGC
TCACCGTGGACAAGAGCAGGTGGCAGCAGGGGAACGTCTTCTCATGCTCCGTGATGCATGAG
GCTCTGCACAACCACTACACGCAGAAGAGCCTCTCCCTGTCTCCGGGTAAA
```
SEQ ID NO: 338

LIGHT CHAIN

*SWALTQPASVSASPGQSVTMSCTGF*GNYNP*DSWYQQYPGKAPKLIIY*EDN*KRPSGVSDRFSASRLGSTSS*
*LTISNVQAADDAHYVC*ASFEF*FGGGTKLTVLSQPKAAPSNYLFPPSSEELQANKAYLNCLNSDFYPGA*
VTVAWKADGSPVKVGVETTKPSKQSNNKYAASSYLSLTPEQWKSHRSYSCRVTHEGSTVEKTVA
PAECS
SEQ ID NO: 339

```
TCCTGGGCCCTGACTCAACCCGCCTCCGTGTCTGCGTCTCCTGGGCAGTCGGTCACCATGTCCT
GCACTGGATTCGGAAATTATAACCCTGACTCCTGGTACCAACAATACCCAGGCAAAGCCCCCA
AACTCATCATTTATGAAGACAATAAAAGACCCTCGGGGGTCTCTGATCGCTTCTCTGCCTCCA
GACTTGGCAGCACGTCTTCCCTGACAATCTCTAACGTCCAGGCTGCGGACGACGCCCATTATG
TCTGCGCCTCCTTTGAATTTTTCGGCGGAGGGACCAAGCTGACCGTCCTGAGTCAGCCCAAGG
CTGCCCCCTCGGTCACTCTGTTCCCACCCTCCTCTGAGGAGCTTCAAGCCAACAAGGCCACAC
TGGTGTGTCTCGTAAGTGACTTCTACCCGGGAGCCGTGACAGTGGCCTGGAAGGCAGATGGCA
GCCCCGTCAAGGTGGGAGTGGAGACCACCAAACCCTCCAAACAAAGCAACAACAAGTATGCG
GCCAGCAGCTACCTGAGCCTGACGCCCGAGCAGTGGAAGTCCCACAGAAGCTACAGCTGCCG
GGTCACGCATGAAGGGAGCACCGTGGAGAAGACAGTGGCCCCTGCAGAATGCTCT
```
SEQ ID NO: 340

>N49P53
HEAVY CHAIN

*RVTLQQSGATVKQPGASVTVSCETS*GYTFTHYT*IHWVRQAPGQGLQWVGR*IHPRTGAV*KYAPIFQGKV*
*SMSRDLSRDTAYLGLTRLTLADTALFFC*ARGAFEADLSGPTYPFHH*WGQGTLVIVS*AASTKGPSVFPL
APSSKSTSGGTAALGCLVKDYFPEPVTVSWNSGALTSGVHTFPAVLQSSGLYSLSSVVTVPSSSLG
TQTYICNVNHKPSNTKVDKRVEPKSCDKTHTCPPCPAPELLGGPSVFLFPPKPKDTLMISRTPEVTC
VVVDVSHEDPEVKFNWYVDGVEVHNAKTKPREEQYNSTYRVVSVLTVLHQDWLNGKEYKCKV
SNKALPAPIEKTISKAKGQPREPQVYTLPPSREEMTKNQVSLTCLVKGFYPSDIAVEWESNGQPEN
NYKTTPPVLDSDGSFFLYSKLTVDKSRWQQGNVFSCSVMHEALHNHYTQKSLSLSPGK
SEQ ID NO: 341

```
CGTGTGACATTACAACAATCTGGGGCTACAGTGAAGCAGCCTGGGGCCTCAGTGACCGTCTCC
TGCGAGACTTCTGGATACACTTTTCACCAAGTATACCATTCACTGGGTGCGACAGGCCCCTGGA
CAGGGTCTTCAGTGGGTGGGCAGAATACACCCCCGAACCGGTGCCGTGAAGTATGCACCGAT
ATTTCAGGGTAAAGTGTCCATGAGTCGAGACTTGTCACGCGACACAGCCTACCTCGGATTGAC
CAGACTGACGCTCGCCGACACGGCTCTATTTTTCTGTGCGAGGGGGGCCTTTGAGGCAGATTT
AAGTGGGCCAACTTACCCCTTTCACCACTGGGGCCAAGGAACCCTAGTCATCGTCTCCGCGGC
CTCCACCAAGGGCCCATCGGTCTTCCCCCTGGCACCCTCCTCCAAGAGCACCTCTGGGGGCAC
AGCGGCCCTGGGCTGCCTGGTCAAGGACTACTTCCCCGAACCGGTGACGGTGTCGTGGAACTC
AGGCGCCCTGACCAGCGGCGTGCACACCTTCCCGGCTGTCCTACAGTCCTCAGGACTCTACTC
CCTCAGCAGCGTGGTGACCGTGCCCTCCAGCAGCTTGGGCACCCAGACCTACATCTGCAACGT
GAATCACAAGCCCAGCAACACCAAGGTGGACAAGAGAGTTGAGCCCAAATCTTGTGACAAAA
CTCACACATGCCCACCGTGCCCAGCACCTGAACTCCTGGGGGGACCGTCAGTCTTCCTCTTCC
CCCCAAAACCCAAGGACACCCTCATGATCTCCCGGACCCCTGAGGTCACATGCGTGGTGGTGG
ACGTGAGCCACGAAGACCCTGAGGTCAAGTTCAACTGGTACGTGGACGGCGTGGAGGTGCAT
AATGCCAAGACAAAGCCGCGGGAGGAGCAGTACAACAGCACGTACCGGGTGGTCAGCGTCCT
CACCGTCCTGCACCAGGACTGGCTGAATGGCAAGGAGTACAAGTGCAAGGTCTCCAACAAAG
CCCTCCCAGCCCCCATCGAGAAAACCATCTCCAAAGCCAAAGGGCAGCCCCGAGAACCACAG
GTGTACACCCTGCCCCCATCCCGGGAGGAGATGACCAAGAACCAGGTCAGCCTGACCTGCCT
GGTCAAAGGCTTCTATCCCAGCGACATCGCCGTGGAGTGGGAGAGCAATGGGCAGCCGGAGA
ACAACTACAAGACCACGCCTCCCGTGCTGGACTCCGACGGCTCCTTCTTCCTCTACAGCAAGC
TCACCGTGGACAAGAGCAGGTGGCAGCAGGGGAACGTCTTCTCATGCTCCGTGATGCATGAG
GCTCTGCACAACCACTACACGCAGAAGAGCCTCTCCCTGTCTCCGGGTAAA
```

LIGHT CHAIN

*SWALTQPASVSASPGQSVTMSCTGF*GNYNP*DSWYQQYPGKAPKLIIY*EDN*KRPSGVSNRFSASRLGSTSS*
*LTISNVQAADDAHYVC*ASFEF*FGGGTKLIVLSQPKAAPSVTLFPPSSEELQANKATLVCLVSDFYPGA*

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

VTVAWKADGSPVKVGVETTKPSKQSNNKYAASSYLSLTPEQWKSHRSYSCRVTHEGSTVEKTVA
PAECS
SEQ ID NO: 343

TCCTGGGCCCTGACTCAACCCGCCTCCGTGTCTGCGTCTCCTGGGCAGTCGGTCACCATGTCCT
GCACTGGATTCGGAAATTATAACCCTGACTCCTGGTACCAACAATACCCAGGCAAAGCCCCCA
AACTCATCATTTATGAGGACAATAAAAGACCCTCGGGAGTCTCTAATCGCTTCTCTGCCTCCA
GACTTGGCAGCACGTCTTCCCTGACAATCTCTAACGTCCAGGCCGCTGACGACGCCCATTATG
TCTGCGCCTCCTTTGAATTTTTCGGCGGAGGGACCAAGCTGACCGTCCTGAGTCAGCCCAAGG
CTGCCCCCTCGGTCACTCTGTTCCCACCCTCCTCTGAGGAGCTTCAAGCCAACAAGGCCACAC
TGGTGTGTCTCGTAAGTGACTTCTACCCGGGAGCCGTGACAGTGGCCTGGAAGGCAGATGGCA
GCCCCGTCAAGGTGGGAGTGGAGACCACCAAACCCTCCAAACAAAGCAACAACAAGTATGCG
GCCAGCAGCTACCTGAGCCTGACGCCCGAGCAGTGGAAGTCCCACAGAAGCTACAGCTGCCG
GGTCACGCATGAAGGGAGCACCGTGGAGAAGACAGTGGCCCCTGCAGAATGCTCT
SEQ ID NO: 344

>N49P54
HEAVY CHAIN

*NVQLMQSGTEVKKSGASVTISCETAGFNFIDSVIHWLRQAPGGGFQWMGWIKPLRGAVNYPQFLQGR*
*VSMTRDLSTDTVYMVLNGLTPDDTGLYYCAKGAFRGGSPFGFWGQGTLLTVS*PASYKGPSNFPLAPSS
KSTSGGTAALGCLVKDYFPEPVTVSWNSGALTSGVHTFPAVLQSSGLYSLSSVVTVPSSSLGTQTY
ICNVNHKPSNTKVDKRVEPKSCDKTHTCPPCPAPELLGGPSVFLFPPKPKDTLMISRTPEVTCVVVD
VSHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSPGK
SEQ ID NO: 345

AACGTGCAGTTGATGCAGTCTGGGACTGAGGTGAAGAAGTCTGGGGCCTCGGTGACAATCTCT
TGTGAGACCGCTGGATTCAACTTCATCGACTCCGTCATACACTGGCTGCGCCAGGCCCCTGGA
GGAGGATTTCAGTGGATGGGGTGGATCAAGCCTCTTAGAGGTGCCGTCAATTATCCACAGTTT
TTGCAGGGCAGGGTCTCCATGACCCGGGACTTGTCCACCGACACGGTGTACATGGTCTTGAAT
GGACTGACACCTGACGACACAGGCCTTTATTACTGCGCGAAAGGGGCCTTTAGAGGGGGTTCT
CCCTTTGGCTTCTGGGGCCAGGGAACTCTGCTCACCGTCTCCTCCGCCTCCACCAAGGGCCCA
TCGGTCTTCCCCCTGGCACCCTCCTCCAAGAGCACCTCTGGGGGCACAGCGGCCCTGGGCTGC
CTGGTCAAGGACTACTTCCCCGAACCGGTGACGGTGTCGTGGAACTCAGGCGCCCTGACCAGC
GGCGTGCACACCTTCCCGGCTGTCCTACAGTCCTCAGGACTCTACTCCCTCAGCAGCGTGGTG
ACCGTGCCCTCCAGCAGCTTGGGCACCCAGACCTACATCTGCAACGTGAATCACAAGCCCAGC
AACACCAAGGTGGACAAGAGAGTTGAGCCCAAATCTTGTGACAAAACTCACACATGCCCACC
GTGCCCAGCACCTGAACTCCTGGGGGGACCGTCAGTCTTCCTCTTCCCCCCAAAACCCAAGGA
CACCCTCATGATCTCCCGGACCCCTGAGGTCACATGCGTGGTGGTGGACGTGAGCCACGAAGA
CCCTGAGGTCAAGTTCAACTGGTACGTGGACGGCGTGGAGGTGCATAATGCCAAGACAAAGC
CGCGGGAGGAGCAGTACAACAGCACGTACCGGGTGGTCAGCGTCCTCACCGTCCTGCACCAG
GACTGGCTGAATGGCAAGGAGTACAAGTGCAAGGTCTCCAACAAAGCCCTCCCAGCCCCCAT
CGAGAAAACCATCTCCAAAGCCAAAGGGCAGCCCCGAGAACCACAGGTGTACACCCTGCCCC
CATCCCGGGAGGAGATGACCAAGAACCAGGTCAGCCTGACCTGCCTGGTCAAAGGCTTCTAT
CCCAGCGACATCGCCGTGGAGTGGGAGAGCAATGGGCAGCCGGAGAACAACTACAAGACCA
CGCCTCCCGTGCTGGACTCCGACGGCTCCTTCTTCCTCTACAGCAAGCTCACCGTGGACAAGA
GCAGGTGGCAGCAGGGGAACGTCTTCTCATGCTCCGTGATGCATGAGGCTCTGCACAACCACT
ACACGCAGAAGAGCCTCTCCCTGTCTCCGGGTAAA
SEQ ID NO: 346

LIGHT CHAIN

*QSALSQPVSVSGSPGESITISCTGATTWYQQLPGRPPKLIIYDVTNRPSGISSRFSGSTSGHTASLTISGLQV*
*DDEGLYHCASREFFGGGTKLTVLS*QPKAAPSVTLFPPSSEELQANKATLVCLVSDFYPGAVTVAWK
ADGSPVKVGVETTKPSKQSNNKYAASSYLSLTPEQWKSHRSYSCRVTHEGSTVEKTVAPAECS
SEQ ID NO: 347

CAGTCTGCCCTGTCTCAGCCTGTCTCCGTGTCTGGGTCTCCTGGAGAGTCGATCACCATTTCCT
GTACTGGAGCCACCACCTGGTATCAACAACTCCCAGGCAGACCCCCCAAACTCATCATTTATG
ACGTCACTAACCGGCCCTCAGGCATTTCTAGTCGTTTCTCTGGCTCCACGTCTGGCCACACGGC
CTCCCTGACAATCTCCGGTCTCCAGGTTGACGACGAGGGTCTGTATCACTGCGCCTCACGTGA
ATTTTTCGGCGAGGGACCAAGCTGACCGTCCTGAGTCAGCCCAAGGCTGCCCCCTCGGTCAC
TCTGTTCCCACCCTCCTCTGAGGAGCTTCAAGCCAACAAGGCCACACTGGTGTGTCTCGTAAG
TGACTTCTACCCGGGAGCCGTGACAGTGGCCTGGAAGGCAGATGGCAGCCCCGTCAAGGTGG
GAGTGGAGACCACCAAACCCTCCAAACAAAGCAACAACAAGTATGCGGCCAGCAGCTACCTG
AGCCTGACGCCCGAGCAGTGGAAGTCCCACAGAAGCTACAGCTGCCGGGTCACGCATGAAGG

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV antibodies are shown below. Variable regions within the heavy and
light chain in the amino acid sequence are italicized and changes
to the amino acid sequence relative to a natural antibody
sequence are underlined. CDR residues are in bold.

```
GAGCACCGTGGAGAAGACAGTGGCCCCTGCAGAATGCTCT
SEQ ID NO: 348

>N49P60
HEAVY CHAIN
```

*QVRLVQSGPQVKKTGASVRVSCETSGYTFTSYFIHWLRLGPGEGLQWMGWINPLHGAVNYENKFRGR
VTITRDTSTDTVYLDMSRLTPDDTAVYFCTRGIVADGWPYGHWGQGTQVTVS*PASYKGPSNFPLAPSS
KSTSGGTAALGCLVKDYFPEPVTVSWNSGALTSGVHTFPAVLQSSGLYSLSSVVTVPSSSLGTQTY
ICNVNHKPSNTKVDKRVEPKSCDKTHTCPPCPAPELLGGPSVFLFPPKPKDTLMISRTPEVTCVVVD
VSHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSPGK
SEQ ID NO: 349

```
CAGGTGCGACTGGTGCAGTCTGGGCCTCAGGTGAAGAAGACTGGGGCCTCAGTGAGGGTCTC
CTGCGAAACCTCTGGATACACGTTCACCTCCTACTTCATCCATTGGTTACGACTGGGCCCCGG
AGAGGGGCTTCAGTGGATGGGGTGGATCAACCCCTTTACATGGTGCCGTGAATTATGAAAACA
AATTTAGGGGCAGGGTCACAATCACCAGGGACACGTCCACAGACACAGTGTATTTGGACATG
AGCAGACTGACCCCTGACGACACGGCCGTCTATTTCTGCACAAGAGGAATCGTTGCTGATGGG
TGGCCCTATGGCCACTGGGGCCAGGGAACCCAAGTCACCGTCTCCCGGCCTCCACCAAGGGC
CCATCGGTCTTCCCCCTGGCACCCTCCTCCAAGAGCACCTCTGGGGGCACAGCGGCCCTGGGC
TGCCTGGTCAAGGACTACTTCCCCGAACCGGTGACGGTGTCGTGGAACTCAGGCGCCCTGACC
AGCGGCGTGCACACCTTCCCGGCTGTCCTACAGTCCTCAGGACTCTACTCCCTCAGCAGCGTG
GTGACCGTGCCCTCCAGCAGCTTGGGCACCCAGACCTACATCTGCAACGTGAATCACAAGCCC
AGCAACACCAAGGTGGACAAGAGAGTTGAGCCCAAATCTTGTGACAAAACTCACACATGCCC
ACCGTGCCCAGCACCTGAACTCCTGGGGGGACCGTCAGTCTTCCTCTTCCCCCCAAAACCCAA
GGACACCCTCATGATCTCCCGGACCCCTGAGGTCACATGCGTGGTGGTGGACGTGAGCCACGA
AGACCCTGAGGTCAAGTTCAACTGGTACGTGGACGGCGTGGAGGTGCATAATGCCAAGACAA
AGCCGCGGGAGGAGCAGTACAACAGCACGTACCGGGTGGTCAGCGTCCTCACCGTCCTGCAC
CAGGACTGGCTGAATGGCAAGGAGTACAAGTGCAAGGTCTCCAACAAAGCCCTCCCAGCCCC
CATCGAGAAACCATCTCCAAAGCCAAAGGGCAGCCCCGAGAACCACAGGTGTACACCCTGC
CCCCATCCCGGGAGGAGATGACCAAGAACCAGGTCAGCCTGACCTGCCTGGTCAAAGGCTTC
TATCCCAGCGACATCGCCGTGGAGTGGGAGAGCAATGGGCAGCCGGAGAACAACTACAAGAC
CACGCCTCCCGTGCTGGACTCCGACGGCTCCTTCTTCCTCTACAGCAAGCTCACCGTGGACAA
GAGCAGGTGGCAGCAGGGGAACGTCTTCTCATGCTCCGTGATGCATGAGGCTCTGCACAACC
ACTACACGCAGAAGAGCCTCTCCCTGTCTCCGGGTAAA
SEQ ID NO: 350
```

LIGHT CHAIN

*SWALTQPASVSGSPGQSVAISCAGGSVSWYQVLPGRAPKLIIYEGAKRPSGVSARFSGSQSGNTAYLTISDL
QTEDEGIYFCSSLQFFGGGTKLTVLS*QPKAAPSVTLFPPSSEELQANKATLVCLVSDFYPGAVTVAW
KADGSPVKVGVETTKPSKQSNNKYAASSYLSLTPEQWKSHRSYSCRVTHEGSTVEKTVAPAECS
SEQ ID NO: 351

```
TCCTGGGCCCTGACTCAGCCTGCCTCCGTGTCTGGGTCTCCTGGACAGTCGGTCGCCATCTCCT
GCGCTGGCGGCAGCGTCTCCTGGTACCAGGTGCTCCCAGGCAGAGCCCCCAAACTCATCATTT
ATGAGGGCGCTAAGCGACCCTCAGGGGTTTCTGCTCGCTTCTCTGGCTCCCAGTCTGGCAACA
CGGCTTACCTGACAATTTCTGACCTCCAGACTGAGGACGAGGGCATCTACTTCTGCTCTTCACT
TCAATTCTTCGGCGGAGGGACCAAACTGACCGTCCTAAGTCAGCCCAAGGCTGCCCCCTCGGT
CACTCTGTTCCCACCCTCCTCTGAGGAGCTTCAAGCCAACAAGGCCACACTGGTGTGTCTCGT
AAGTGACTTCTACCCGGGAGCCGTGACAGTGGCCTGGAAGGCAGATGGCAGCCCCGTCAAGG
TGGGAGTGGAGACCACCAAACCCTCCAAACAAAGCAACAACAAGTATGCGGCCAGCAGCTAC
CTGAGCCTGACGCCCGAGCAGTGGAAGTCCCACAGAAGCTACAGCTGCCGGGTCACGCATGA
AGGGAGCACCGTGGAGAAGACAGTGGCCCCTGCAGAATGCTCT
SEQ ID NO: 352

>N49P61
HEAVY CHAIN
```

*QVRLQQSGWVRKPGASVRISCETSGFTFIDHIVHWVRRAPGRGFEWMGWIKPLRGAVDYAPQLRGRI
SLTRDIYSETVFIDVSRLTSGDTAIYFCCKAAAPEEAFPLQYWGQGTQLIVSS*ASYKGPSVFPLAPSSKST
SGGTAALGCLVKDYFPEPVTVSWNSGALTSGVHTFPAVLQSSGLYSLSSVVTVPSSSLGTQTYICN
VNHKPSNTKVDKRVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPA
PIEKTISKAKGQPREPQVYTLPPSREEMTKNQVSLTCLVKGFYPSDIAVEWESNGQPENNYKTTPPV

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

LDSDGSFFLYSKLTVDKSRWQQGNVFSCSVMHEALHNHYTQKSLSLSPGK
SEQ ID NO: 353

CAGGTGCGACTTCAGCAGTCTGGTGTCGTGGTGAGGAAGCCTGGGGCCTCAGTGAGAATTTCC
TGCGAGACTTCTGGATTCACCTTCATCGACCACATTGTCCATTGGGTGCGGCGGGCCCCTGGA
CGAGGCTTTGAATGGATGGGTTGGATCAAGCCTCTTAGGGGTGCCGTAGATTATGCACCCCAA
CTTCGGGGCAGGATCTCCCTGACGAGGGACATTTACAGTGAAACCGTCTTTATAGACGTGAGC
CGACTGACGTCTGGCGACACGGCGATATACTTTTGTTGTAAGGCCGCCGCCCCTGAAGAAGCA
TTCCCCCTTCAATACTGGGGCCAGGGGACCCAACTTATCGTCTCCGGCCTCCACCAAGGGC
CCATCGGTCTTCCCCCTGGCACCCTCCTCCAAGAGCACCTCTGGGGGCACAGCGGCCCTGGGC
TGCCTGGTCAAGGACTACTTCCCCGAACCGGTGACGGTGTCGTGGAACTCAGGCGCCCTGACC
AGCGGCGTGCACACCTTCCCGGCTGTCCTACAGTCCTCAGGACTCTACTCCCTCAGCAGCGTG
GTGACCGTGCCCTCCAGCAGCTTGGGCACCCAGACCTACATCTGCAACGTGAATCACAAGCCC
AGCAACACCAAGGTGGACAAGAGAGTTGAGCCCAAATCTTGTGACAAAACTCACACATGCCC
ACCGTGCCCAGCACCTGAACTCCTGGGGGGACCGTCAGTCTTCCTCTTCCCCCCAAAACCCAA
GGACACCCTCATGATCTCCCGGACCCCTGAGGTCACATGCGTGGTGGTGGACGTGAGCCACGA
AGACCCTGAGGTCAAGTTCAACTGGTACGTGGACGGCGTGGAGGTGCATAATGCCAAGACAA
AGCCGCGGGAGGAGCAGTACAACAGCACGTACCGGGTGGTCAGCGTCCTCACCGTCCTGCAC
CAGGACTGGCTGAATGGCAAGGAGTACAAGTGCAAGGTCTCCAACAAAGCCCTCCCAGCCCC
CATCGAGAAAACCATCTCCAAAGCCAAAGGGCAGCCCCGAGAACCACAGGTGTACACCCTGC
CCCCATCCCGGGAGGAGATGACCAAGAACCAGGTCAGCCTGACCTGCCTGGTCAAAGGCTTC
TATCCCAGCGACATCGCCGTGGAGTGGGAGAGCAATGGGCAGCCGGAGAACAACTACAAGAC
CACGCCTCCCGTGCTGGACTCCGACGGCTCCTTCTTCCTCTACAGCAAGCTCACCGTGGACAA
GAGCAGGTGGCAGCAGGGGAACGTCTTCTCATGCTCCGTGATGCATGAGGCTCTGCACAACC
ACTACACGCAGAAGAGCCTCTCCCTGTCTCCGGGTAAA
SEQ ID NO: 354

LIGHT CHAIN

*QAALTQPASVSGSPGQSVTISCLYA*__NVDI__*CWYQLHPGRAPKLLIV*__DNN__*KRPSGVSPRFSGSKSGTTASLTIS*
*GLQADDEAEYHC*__SSRTF__*FGGGTKLTVLS*QPKAAPSVTLFPPSSEELQANKATLVCLVSDFYPGAVTV
AWKADGSPVKVGETTKPSKQSNNKYAASSYLSLTPEQWKSHRSYSCRVTHEGSTVEKTVAPAE
CS
SEQ ID NO: 355

CAGGCTGCCCTGACTCAGCCCGCCTCCGTGTCCGGCTCTCCTGGACAGTCGGTCACCATTTCCT
GCCTTTATGCCAATGTAGATATCTGCTGGTATCAACTACACCCGGGCAGAGCCCCCAAACTTC
TAATTGTTGACAATAATAAGCGGCCCTCAGGAGTCTCTCCTGGCTTCTCTGGCTCCAAGTCTGG
CACCACGGCCTCCCTGACAATCTCTGGACTTCAGGCTGACGACGAGGCTGAATATCACTGCTC
TTCAAGAACATTTTTTGGCGGGGGGACCAAGTTGACCGTCCTGAGTCAGCCCAAGGCTGCCCC
CTCGGTCACTCTGTTCCCACCCTCCTCTGAGGAGCTTCAAGCCAACAAGGCCACACTGGTGTG
TCTCGTAAGTGACTTCTACCCGGGAGCCGTGACAGTGGCCTGGAAGGCAGATGGCAGCCCCGT
CAAGGTGGGAGTGGAGACCACCAAACCCTCCAAACAAAGCAACAACAAGTATGCGGCCAGC
AGCTACCTGAGCCTGACGCCCGAGCAGTGGAAGTCCCACAGAAGCTACAGCTGCCGGGTCAC
GCATGAAGGGAGCACCGTGGAGAAGACAGTGGCCCCTGCAGAATGCTCT
SEQ ID NO: 356

>N49P62
HEAVY CHAIN

*QVRLQQSGVVVRKPGASVRLSCETS*__GFKFIDHI__*VNWVRRAPGRGFEWMGW*__IKPLGGVA__*DYAPQHRGR*
*ISLTRDIYTETVFIDLSRLTSGDTAIYFC*__CKAAAPDEAFPLEY__*WGQGTQLIVS*PASYKGPSNFPLAPSSKS
TSGGTAALGCLVKDYFPEPVTVSWNSGALTSGVHTFPAVLQSSGLYSLSSVVTVPSSSLGTQTYIC
NVNHKPSNTKVDKRVEPKSCDKTHTCPPCPAPELLGGPSVFLFPPKPKDTLMISRTPEVTCVVVDV
SHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPP
VLDSDGSFFLYSKLTVDKSRWQQGNVFSCSVMHEALHNHYTQKSLSLSPGK
SEQ ID NO: 357

CAGGTGCGACTTCAGCAGTCTGGTGTCGTGGTGAGGAAGCCTGGGGCCTCAGTGAGACTTTCC
TGCGAGACGTCTGGATTCAAATTCATCGACCACATTGTCAACTGGGTGCGGCGGGCCCCTGGA
CGAGGCTTTGAATGGATGGGTTGGATCAAGCCTCTTGGGGGTGTCGCTGATTATGCACCCCAA
CATCGGGGCAGGATCTCACTGACGAGGGACATTTACACTGAAACCGTCTTTATAGACCTGAGT
CGACTGACGTCTGGCGACACGGCGATTTATTTCTGTTGTAAGGCCGCCGCCCCTGATGAAGCA
TTCCCCCTTGAATACTGGGGCCAGGGGACCCAACTTATCGTCTCCCGGCCTCCACCAAGGGC
CCATCGGTCTTCCCCCTGGCACCCTCCTCCAAGAGCACCTCTGGGGGCACAGCGGCCCTGGGC
TGCCTGGTCAAGGACTACTTCCCCGAACCGGTGACGGTGTCGTGGAACTCAGGCGCCCTGACC
AGCGGCGTGCACACCTTCCCGGCTGTCCTACAGTCCTCAGGACTCTACTCCCTCAGCAGCGTG

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

```
GTGACCGTGCCCTCCAGCAGCTTGGGCACCCAGACCTACATCTGCAACGTGAATCACAAGCCC
AGCAACACCAAGGTGGACAAGAGAGTTGAGCCCAAATCTTGTGACAAAACTCACACATGCCC
ACCGTGCCCAGCACCTGAACTCCTGGGGGGACCGTCAGTCTTCCTCTTCCCCCCAAAACCCAA
GGACACCCTCATGATCTCCCGGACCCCTGAGGTCACATGCGTGGTGGTGGACGTGAGCCACGA
AGACCCTGAGGTCAAGTTCAACTGGTACGTGGACGGCGTGGAGGTGCATAATGCCAAGACAA
AGCCGCGGGAGGAGCAGTACAACAGCACGTACCGGGTGGTCAGCGTCCTCACCGTCCTGCAC
CAGGACTGGCTGAATGGCAAGGAGTACAAGTGCAAGGTCTCCAACAAAGCCCTCCCAGCCCC
CATCGAGAAAACCATCTCCAAAGCCAAAGGGCAGCCCCGAGAACCACAGGTGTACACCCTGC
CCCCATCCCGGGAGGAGATGACCAAGAACCAGGTCAGCCTGACCTGCCTGGTCAAAGGCTTC
TATCCCAGCGACATCGCCGTGGAGTGGGAGAGCAATGGGCAGCCGGAGAACAACTACAAGAC
CACGCCTCCCGTGCTGGACTCCGACGGCTCCTTCTTCCTCTACAGCAAGCTCACCGTGGACAA
GAGCAGGTGGCAGCAGGGGAACGTCTTCTCATGCTCCGTGATGCATGAGGCTCTGCACAACC
ACTACACGCAGAAGAGCCTCTCCCTGTCTCCGGGTAAA
SEQ ID NO: 358
```

LIGHT CHAIN

*QAALTQPASVSGSPGQSVTISCLYANVDICWYQIQPGRLPKLLIVDNNRRPSGVSPRFSGSKSGTTASLTIS GLQADDEAEYHCSSTTFFGGGTKLTVLSQPKAAPSVTLFPPSSEELQANKATLVCLVSDFYPGAVTV* AWKADGSPVKVGVETTKPSKQSNNKYAASSYLSLTPEQWKSHRSYSCRVTHEGSTVEKTVAPAE
CS
SEQ ID NO: 359

```
CAGGCTGCCCTGACTCAGCCCGCCTCCGTGTCCGGCTCTCCTGGACAGTCGGTCACCATTTCCT
GCCTTTATGCCAATGTAGATATCTGCTGGTATCAAATACAGCCGGGCAGATTACCCAAACTTC
TGATTGTTGACAATAATAGGCGACCCTCAGGAGTCTCTCCTGGCTTCTCTGGCTCCAAGTCTGG
CACCACGGCCTCCCTGACAATCTCTGGACTTCAGGCTGACGACGAGGCTGAATATCACTGCTC
TTCAACAACATTTTTTGGCGGGGGGACCAAGTTGACCGTCCTCAGTCAGCCCAAGGCTGCCCC
CTCGGTCACTCTGTTCCCACCCTCCTCTGAGGAGCTTCAAGCCAACAAGGCCACACTGGTGTG
TCTCGTAAGTGACTTCTACCCGGGAGCCGTGACAGTGGCCTGGAAGGCAGATGGCAGCCCCGT
CAAGGTGGGAGTGGAGACCACCAAACCCTCCAAACAAAGCAACAACAAGTATGCGGCCAGC
AGCTACCTGAGCCTGACGCCCGAGCAGTGGAAGTCCCACAGAAGCTACAGCTGCCGGGTCAC
GCATGAAGGGAGCACCGTGGAGAAGACAGTGGCCCCTGCAGAATGCTCT
SEQ ID NO: 360
```

>N49P63
HEAVY CHAIN

*QVRLVQSGPVMRKPGASVRISCETSGFAFLDHIVHWVRRAPGRGFEWMGWVKTIGGVVDYAPHLRGR ISVTRDVFSETVFLDLSRLTSGDTAMYFCSKAAAPDEAFPLEFWGQGTQVIVSSA*SYKGPSNFPLAPSS KSTSGGTAALGCLVKDYFPEPVTVSWNSGALTSGVHTFPAVLQSSGLYSLSSVVTVPSSSLGTQTY ICNVNHKPSNTKVDKRVEPKSCDKTHTCPPCPAPELLGGPSVFLFPPKPKDTLMISRTPEVTCVVVD VSHEDPEVKFNWYVDG̅VEVHNAKTKPREEQYNSTYRVVSVLTVLHQDWLNGKEYKCKVSNKAL PAPIEKTISKAKGQPREPQVYTLPPSREEMTKNQVSLTCLVKGFYPSDIAVEWESNGQPENNYKTTP PVLDSDGSFFLYSKLTVDKSRWQQGNVF̅S̅C̅SVMHEALHNHYTQKSLSLSPGK
SEQ ID NO: 361

```
CAGGTGCGACTTGTGCAGTCTGGTCCCGTGATGAGAAAGCCTGGGGCCTCAGTGAGAATTTCT
TGCGAGACATCTGGATTCGCCTTCTTGGACCACATTGTCCACTGGGTGCGGCGGGCCCCTGGA
CGCGGCTTTGAATGGATGGGTTGGGTTAAGACCATTGGGGGTGTCGTTGATTATGCACCCCAC
CTTAGGGGCAGGATCTCCGTGACGAGAGACGTCTTTAGTGAAACCGTCTTTCTGGACTTGAGC
CGACTGACGTCTGGCGACACGGCGATGTATTTTTGTTCTAAGGCCGCCGCCCCTGACGAAGCC
TTCCCCCTTGAATTTTGGGCAGGGGACCCAAGTCATCGTCTCCTCGGCCTCCACCAAGGGC
CCATCGGTCTTCCCCCTGGCACCCTCCTCCAAGAGCACCTCTGGGGGCACAGCGGCCCTGGGC
TGCCTGGTCAAGGACTACTTCCCCGAACCGGTGACGGTGTCGTGGAACTCAGGCGCCCTGACC
AGCGGCGTGCACACCTTCCCGGCTGTCCTACAGTCCTCAGGACTCTACTCCCTCAGCAGCGTG
GTGACCGTGCCCTCCAGCAGCTTGGGCACCCAGACCTACATCTGCAACGTGAATCACAAGCCC
AGCAACACCAAGGTGGACAAGAGAGTTGAGCCCAAATCTTGTGACAAAACTCACACATGCCC
ACCGTGCCCAGCACCTGAACTCCTGGGGGGACCGTCAGTCTTCCTCTTCCCCCCAAAACCCAA
GGACACCCTCATGATCTCCCGGACCCCTGAGGTCACATGCGTGGTGGTGGACGTGAGCCACGA
AGACCCTGAGGTCAAGTTCAACTGGTACGTGGACGGCGTGGAGGTGCATAATGCCAAGACAA
AGCCGCGGGAGGAGCAGTACAACAGCACGTACCGGGTGGTCAGCGTCCTCACCGTCCTGCAC
CAGGACTGGCTGAATGGCAAGGAGTACAAGTGCAAGGTCTCCAACAAAGCCCTCCCAGCCCC
CATCGAGAAAACCATCTCCAAAGCCAAAGGGCAGCCCCGAGAACCACAGGTGTACACCCTGC
CCCCATCCCGGGAGGAGATGACCAAGAACCAGGTCAGCCTGACCTGCCTGGTCAAAGGCTTC
TATCCCAGCGACATCGCCGTGGAGTGGGAGAGCAATGGGCAGCCGGAGAACAACTACAAGAC
CACGCCTCCCGTGCTGGACTCCGACGGCTCCTTCTTCCTCTACAGCAAGCTCACCGTGGACAA
GAGCAGGTGGCAGCAGGGGAACGTCTTCTCATGCTCCGTGATGCATGAGGCTCTGCACAACC
```

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

ACTACACGCAGAAGAGCCTCTCCCTGTCTCCGGGTAAA
SEQ ID NO: 362

LIGHT CHAIN

QAALTQPASVSGSPGQSVTISCLYA*NVD*I*CWYQLHPGRAPKLLIL*DNN**KRPSGVSSRFSGSKSGTTASLTIS
DLQADDEAEYHCSSTTFFGGGTRLTVLS*QPKAAPSVTLFPPSSEELQANKATLVCLVSDFYPGAVTV
AWKADGSPVKVGVETTKPSKQSNNKYAASSYLSLTPEQWKSHRSYSCRVTHEGSTVEKTVAPAE
CS
SEQ ID NO: 363

CAGGCTGCCCTGACTCAGCCCGCCTCCGTGTCCGGCTCTCCTGGACAGTCGGTCACCATTTCTT
GCCTTTATGCCAATGTGGATATCTGCTGGTATCAACTTCACCCGGGCAGAGCCCCCAAACTTC
TTATTCTTGACAATAATAAACGGCCCTCAGGAGTCTCTAGTCGCTTCTCCGGTTCCAAGTCTGG
CACCACGGCCTCCCTAACCATCTCTGACCTTCAGGCTGACGACGAGGCTGAATATCACTGCTC
TTCAACAACATTTTTTGGCGGGGGGACCAGGTTGACCGTCCTGAGTCAGCCCAAGGCTGCCCC
CTCGGTCACTCTGTTCCCACCCTCCTCTGAGGAGCTTCAAGCCAACAAGGCCACACTGGTGTG
TCTCGTAAGTGACTTCTACCCGGGAGCCGTGACAGTGGCCTGGAAGGCAGATAGGCAGCCCCGT
CAAGGTGGGAGTGGAGACCACCAAACCCTCCAAACAAAGCAACAACAAGTATGCGGCCAGC
AGCTACCTGAGCCTGACGCCCGAGCAGTGGAAGTCCCACAGAAGCTACAGCTGCCGGGTCAC
GCATGAAGGGAGCACCGTGGAGAAGACAGTGGCCCCTGCAGAATGCTCT
SEQ ID NO: 364

>N49P64
HEAVY CHAIN

*QVRLVQSGPWRKPGTSVRISCETS*GFAFLDHI*VHWVRRAPGRGFEWMGW*VKTIGGVV*DYAPHLRGRI
SVTRDVFSEIVFMELSRLTSGDTAMYFC*SKAAAPDEAFPLEF*WGQGTQVIVSS*ASYKGPSNFPLAPSSK
STSGGTAALGCLVKDYFPEPVTVSWNSGALTSGVHTFPAVLQSSGLYSLSSVVTVPSSSLGTQTYIC
NVNHKPSNTKVDKRVEPKSCDKTHTCPPCPAPELLGGPSVFLFPPKPKDTLMISRTPEVTCVVVDV
SHEDPEVKFNWYVD̲GVEVHNAKTKPREEQYNSTYRVVSVLTVLHQDWLNGKEYKCKVSNKALP
APIEKTISKAKGQPREPQVYTLPPSREE̲MTKNQVSLTCLVKGFYPSDIAVEWESNGQPENNYKTTPP
VLDSDGSFFLYSKLTVDKSRWQQGNVFS̲CSVMHEALHNHYTQKSLSLSPGK
SEQ ID NO: 365

CAGGTGCGACTTGTGCAGTCTGGTCCCGTGGTGAGAAAGCCTGGGACCTCAGTGAGAATTTCT
TGCGAGACATCTGGATTCGCCTTCTTGGACCACATTGTCCACTGGGTGCGGCGGGCCCCTGGA
CGCGGCTTTGAATGGATGGGTTGGGTTAAGACCATTGGGGGTGTCGTTGATTATGCACCCCAC
CTTAGGGGCAGGATCTCCGTGACGAGGGACGTATTTAGTGAAATCGTCTTTATGGAGTTGAGT
CGACTGACGTCTGGCGACACGGCGATGTATTTTTGTTCTAAGGCCGCGCCCCTGACGAAGCC
TTCCCCCTTGAATTTTGGGGCAGGGGACCCAAGTCATCGTCTCCTCGGCCTCCACCAAGGGC
CCATCGGTCTTCCCCCTGGCACCCTCCTCCAAGAGCACCTCTGGGGGCACAGCGGCCCTGGGC
TGCCTGGTCAAGGACTACTTCCCCGAACCGGTGACGGTGTCGTGGAACTCAGGCGCCCTGACC
AGCGGCGTGCACACCTTCCCGGCTGTCCTACAGTCCTCAGGACTCTACTCCCTCAGCAGCGTG
GTGACCGTGCCCTCCAGCAGCTTGGGCACCCAGACCTACATCTGCAACGTGAATCACAAGCCC
AGCAACACCAAGGTGGACAAGAGAGTTGAGCCCAAATCTTGTGACAAAACTCACACATGCCC
ACCGTGCCCAGCACCTGAACTCCTGGGGGGACCGTCAGTCTTCCTCTTCCCCCCAAAACCCAA
GGACACCCTCATGATCTCCCGGACCCCTGAGGTCACATGCGTGGTGGTGGACGTGAGCCACGA
AGACCCTGAGGTCAAGTTCAACTGGTACGTGGACGGCGTGGAGGTGCATAATGCCAAGACAA
AGCCGCGGGAGGAGCAGTACAACAGCACGTACCGGGTGGTCAGCGTCCTCACCGTCCTGCAC
CAGGACTGGCTGAATGGCAAGGAGTACAAGTGCAAGGTCTCCAACAAAGCCCTCCCAGCCCC
CATCGAGAAAACCATCTCCAAAGCCAAAGGGCAGCCCCGAGAACCACAGGTGTACACCCTGC
CCCCATCCCGGGAGGAGATGACCAAGAACCAGGTCAGCCTGACCTGCCTGGTCAAAGGCTTC
TATCCCAGCGACATCGCCGTGGAGTGGGAGAGCAATGGGCAGCCGGAGAACAACTACAAGAC
CACGCCTCCCGTGCTGGACTCCGACGGCTCCTTCTTCCTCTACAGCAAGCTCACCGTGGACAA
GAGCAGGTGGCAGCAGGGGAACGTCTTCTCATGCTCCGTGATGCATGAGGCTCTGCACAACC
ACTACACGCAGAAGAGCCTCTCCCTGTCTCCGGGTAAA
SEQ ID NO: 366

LIGHT CHAIN

*QAALTQPASVSGSPGQSVTISCLYA*NVD*I*CWYQLHPGRAPKLLIV*DNN*KRPSGVSSRFSGSKSGTTASLTIS
DLQADDEAEYHC*SSTTF*FGGGTRLTVLS*QPKAAPSVTLFPPSSEELQANKATLVCLVSDFYPGAVTV
AWKADGSPVKVGVETTKPSKQSNNKYAASSYLSLTPEQWKSHRSYSCRVTHEGSTVEKTVAPAE
CS
SEQ ID NO: 367

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

```
CAGGCTGCCCTGACTCAGCCCGCCTCCGTGTCCGGCTCTCCTGGACAGTCGGTCACCATTTCCT
GCCTTTATGCCAATGTGGATATCTGCTGGTATCAACTTCACCCGGGCAGAGCCCCCAAACTTC
TAATTGTTGACAATAATAAGCGGCCCTCAGGAGTCTCTAGTCGCTTCTCTGGTTCCAAGTCTGG
CACCACGGCCTCCCTAACAATCTCTGATCTTCAGGCTGACGAGGCAGGCTGAATATCACTGCTC
TTCAACAACATTTTTTGGCGGGGGGACCAGGTTGACCGTCCTGAGTCAGCCCAAGGCTGCCCC
CTCGGTCACTCTGTTCCCACCCTCCTCTGAGGAGCTTCAAGCCAACAAGGCCACACTGGTGTG
TCTCGTAAGTGACTTCTACCCGGGAGCCGTGACAGTGGCCTGGAAGGCAGATGGCAGCCCCGT
CAAGGTGGGAGTGGAGACCACCAAACCCTCCAAACAAAGCAACAACAAGTATGCGGCCAGC
AGCTACCTGAGCCTGACGCCCGAGCAGTGGAAGTCCCACAGAAGCTACAGCTGCCGGGTCAC
GCATGAAGGGAGCACCGTGGAGAAGACAGTGGCCCCTGCAGAATGCTCT
SEQ ID NO: 368

>N49P65
HEAVY CHAIN
```

*QVQLVQSGAGVKKPGASVRVSCETS*GFKFTEYF*IHFLRQAPGQGLEWMGW*LNPLRGAV*NYPRKFQG
RVTLTRDIYTTTVYMQLNGLTPDDTAVYYC*ARAVFNEAFPFDY*WGQGSLVTVSS*ASYKGPSNFPLAPSS
KSTSGGTAALGCLVKDYFPEPVTVSWNSGALTSGVHTFPAVLQSSGLYSLSSVVTVPSSSLGTQTY
ICNVNHKPSNTKVDK<u>R</u>VEPKSCDKTHTCPPCPAPELLGGPSVFLFPPKPKDTLMISRTPEVTCVVVD
VSHEDPEVKFNWYVD<u>G</u>VEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTP
PVLDSDGSFFLYSKLTVDKSRWQQGNVF<u>S</u>C<u>S</u>VMHEALHNHYTQKSLSLSPGK
SEQ ID NO: 369

```
CAAGTGCAACTGGTGCAGTCTGGGGCTGGGGTGAAGAAGCCTGGGGCCTCAGTGAGGGTCTC
CTGCGAGACATCCGGATTCAAGTTCACCGAGTACTTTATCCACTTTTTACGACAGGCCCCTGG
ACAAGGGCTTGAGTGGATGGGATGGCTCAACCCTCTCAGAGGTGCCGTCAACTATCCACGGA
AGTTTCAGGGCAGAGTCACTTTGACCAGGGACATCTACACCACCACCGTCTACATGCAACTTA
ACGGTCTGACCCCTGACGACACGGCCGTCTACTACTGTGCCAGACGGTCTTTAATGAAGCTT
TCCCCTTTGACTACTGGGGCCAGGGAAGCCTGGTCACCGTCTCCTCAGCCTCCACCAAGGGCC
CATCGGTCTTCCCCCTGGCACCCTCCTCCAAGAGCACCTCTGGGGGCACAGCGGCCCTGGGCT
GCCTGGTCAAGGACTACTTCCCCGAACCGGTGACGGTGTCGTGGAACTCAGGCGCCCTGACCA
GCGGCGTGCACACCTTCCCGGCTGTCCTACAGTCCTCAGGACTCTACTCCCTCAGCAGCGTGG
TGACCGTGCCCTCCAGCAGCTTGGGCACCCAGACCTACATCTGCAACGTGAATCACAAGCCCA
GCAACACCAAGGTGGACAAGAGAGTTGAGCCCAAATCTTGTGACAAAACTCACACATGCCCA
CCGTGCCCAGCACCTGAACTCCTGGGGGGACCGTCAGTCTTCCTCTTCCCCCCAAAACCCAAG
GACACCCTCATGATCTCCCGGACCCCTGAGGTCACATGCGTGGTGGTGGACGTGAGCCACGAA
GACCCTGAGGTCAAGTTCAACTGGTACGTGGACGGCGTGGAGGTGCATAATGCCAAGACAAA
GCCGCGGGAGGAGCAGTACAACAGCACGTACCGGGTGGTCAGCGTCCTCACCGTCCTGCACC
AGGACTGGCTGAATGGCAAGGAGTACAAGTGCAAGGTCTCCAACAAAGCCCTCCCAGCCCCC
ATCGAGAAAACCATCTCCAAAGCCAAAGGGCAGCCCCGAGAACCACAGGTGTACACCCTGCC
CCCATCCCGGGAGGAGATGACCAAGAACCAGGTCAGCCTGACCTGCCTGGTCAAAGGCTTCT
ATCCCAGCGACATCGCCGTGGAGTGGGAGAGCAATGGGCAGCCGGAGAACAACTACAAGACC
ACGCCTCCCGTGCTGGACTCCGACGGCTCCTTCTTCCTCTACAGCAAGCTCACCGTGGACAAG
AGCAGGTGGCAGCAGGGGAACGTCTTCTCATGCTCCGTGATGCATGAGGCTCTGCACAACCAC
TACACGCAGAAGAGCCTCTCCCTGTCTCCGGGTAAA
SEQ ID NO: 370

LIGHT CHAIN
```

*SWAQTQPASVSGSPGQSITISCAGI*VS*DAWYQQYPGRPPRLILY*DGD*KRPSGVSPRFSASRAGKTASLTISG
LQADDEAYYHQ*<u>ASREF</u>**FGGVTKLTVLSQPKAAPSVTLFPPSSEELQANKATLVCLVSDFYPGAVTVA
WKADGSPVKVGVETTKPSKQSNNKYAASSYLSLTPEQWKSHRSYSCRVTHEGSTVEKTVAPAEC
S*
SEQ ID NO: 371

```
TCCTGGGCCCAGACTCAGCCTGCCTCCGTGTCTGGGTCTCCTGGACAGTCGATCACCATCTCCT
GCGCTGGAATCGTCAGTGATGCCTGGTACCAGCAATACCCAGGCAGACCCCCCAGACTCATCC
TTTATGACGGCGATAAGCGGCCCTCAGGGGTTTCTCCTCGTTTTTCTGCCTCCAGGGCCGGCAA
GACGGCCTCCCTGACAATTTCTGGGCTGCAGGCTGACGACGAGGCTTATTATCACTGCGCGTC
AAGGGAATTTTTTGGAGGCGTGACCAAGTTGACCGTCCTAAGTCAGCCCAAGGCTGCCCCTC
GGTCACTCTGTTCCCACCCTCCTCTGAGGAGCTTCAAGCCAACAAGGCCACACTGGTGTGTCT
CGTAAGTGACTTCTACCCGGGAGCCGTGACAGTGGCCTGGAAGGCAGATGGCAGCCCCGTCA
AGGTGGGAGTGGAGACCACCAAACCCTCCAAACAAAGCAACAACAAGTATGCGGCCCAGCAG
CTACCTGAGCCTGACGCCCGAGCAGTGGAAGTCCCACAGAAGCTACAGCTGCCGGGTCACGC
ATGAAGGGAGCACCGTGGAGAAGACAGTGGCCCCTGCAGAATGCTCT
SEQ ID NO: 372
```

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

>N49P66
HEAVY CHAIN

*QVRLQQSGVVVRKPGASVRLSCETS**GFKFIDHIVNWVRRAPGRGFEWMGWIKPLGGVA**DYAPQHRGR*
*ISLTRDIYTETVFIDLSRLTSGDTAIYFC**KAAAPDEAFPLEY**WGQGTQLIVS*PASYKGPSNFPLAPSSKS
TSGGTAALGCLVKDYFPEPVTVSWNSGALTSGVHTFPAVLQSSGLYSLSSVVTVPSSSLGTQTYIC
NVNHKPSNTKVDKRVEPKSCDKTHTCPPCPAPELLGGPSVFLFPPKPKDTLMISRTPEVTCVVVDV
SHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPP
VLDSDGSFFLYSKLTVDKSRWQQGNVFSCSVMHEALHNHYTQKSLSLSPGK
SEQ ID NO: 373

CAGGTGCGACTTCAGCAGTCTGGTGTCGTGGTGAGGAAGCCTGGGGCCTCAGTGAGACTTTCC
TGCGAGACGTCTGGCTTCAAATTCATCGACCACATTGTCAACTGGGTGCGGCGGGCCCCTGGA
CGAGGCTTTGAATGGATGGGTTGGATCAAGCCTCTTGGGGGTGTCGCTGATTATGCACCCCAA
CATCGGGGCAGGATCTCACTGACGAGGGACATTTACACTGAAACCGTCTTTATAGACCTGAGT
CGACTGACGTCTGGCGACACGGCGATTTATTTTTGTTGTAAGGCCGCCGCCCCTGATGAAGCA
TTCCCCCTTGAATACTGGGGCCAGGGGACCCAACTTATCGTCTCCCCGGCCTCCACCAAGGGC
CCATCGGTCTTCCCCCTGGCACCCTCCTCCAAGAGCACCTCTGGGGGCACAGCGGCCCTGGGC
TGCCTGGTCAAGGACTACTTCCCCGAACCGGTGACGGTGTCGTGGAACTCAGGCGCCCTGACC
AGCGGCGTGCACACCTTCCCGGCTGTCCTACAGTCCTCAGGACTCTACTCCCTCAGCAGCGTG
GTGACCGTGCCCTCCAGCAGCTTGGGCACCCAGACCTACATCTGCAACGTGAATCACAAGCCC
AGCAACACCAAGGTGGACAAGAGAGTTGAGCCCAAATCTTGTGACAAAACTCACACATGCCC
ACCGTGCCCAGCACCTGAACTCCTGGGGGGACCGTCAGTCTTCCTCTTCCCCCCAAAACCCAA
GGACACCCTCATGATCTCCCGGACCCCTGAGGTCACATGCGTGGTGGTGGACGTGAGCCACGA
AGACCCTGAGGTCAAGTTCAACTGGTACGTGGACGGCGTGGAGGTGCATAATGCCAAGACAA
AGCCGCGGGAGGAGCAGTACAACAGCACGTACCGGGTGGTCAGCGTCCTCACCGTCCTGCAC
CAGGACTGGCTGAATGGCAAGGAGTACAAGTGCAAGGTCTCCAACAAAGCCCTCCCAGCCCC
CATCGAGAAAACCATCTCCAAAGCCAAAGGGCAGCCCCGAGAACCACAAGGTGTACACCCTGC
CCCCATCCCGGGAGGAGATGACCAAGAACCAGGTCAGCCTGACCTGCCTGGTCAAAGGCTTC
TATCCCAGCGACATCGCCGTGGAGTGGGAGAGCAATGGGCAGCCGGAGAACAACTACAAGAC
CACGCCTCCCGTGCTGGACTCCGACGGCTCCTTCTTCCTCTACAGCAAGCTCACCGTGGACAA
GAGCAGGTGGCAGCAGGGGAACGTCTTCTCATGCTCCGTGATGCATGAGGCTCTGCACAACC
ACTACACGCAGAAGAGCCTCTCCCTGTCTCCGGGTAAA
SEQ ID NO: 374

LIGHT CHAIN

*QAALTQPASVSGSPGQSVTISCLYA**NVDICWYQIQPGRLPKLLIVDND**RRPSGVSPRFSGSKSGTTASLTIS*
*GLQADDEAEYHC**SSTTF**FGGGTKLTVLS*QPKAAPSVTLFPPSSEELQANKATLVCLVSDFYPGAVTV
AWKADGSPVKVGVETTKPSKQSNNKYAASSYLSLTPEQWKSHRSYSCRVTHEGSTVEKTVAPAE
CS
SEQ ID NO: 375

CAGGCTGCCCTGACTCAGCCCGCCTCCGTGTCCGGCTCTCCTGGACAGTCGGTCACCATTTCCT
GCCTTTATGCCAATGTAGATATCTGCTGGTATCAAATACAGCCGGGCAGATTACCCAAACTTC
TGATTGTTGACAATGATAGGCGACCCTCAGGAGTCTCTCCTCGCTTCTCTGGCTCCAAGTCTGG
CACCACGGCCTCCCTGACAATCTCTGGACTTCAGGCTGACGACGAGGCTGAATATCACTGCTC
TTCAACAACATTTTTTGGCGGGGGGACCAAGTTGACCGTCCTCAGTCAGCCCAAGGCTGCCCC
CTCGGTCACTCTGTTCCCACCCTCCTCTGAGGAGCTTCAAGCCAACAAGGCCACACTGGTGTG
TCTCGTAAGTGACTTCTACCCGGGAGCCGTGACAGTGGCCTGGAAGGCAGATGGCAGCCCCGT
CAAGGTGGGAGTGGAGACCACCAAACCCTCCAAACAAAGCAACAACAAGTATGCGGCCAGC
AGCTACCTGAGCCTGACGCCCGAGCAGTGGAAGTCCCACAGAAGCTACAGCTGCCGGGTCAC
GCATGAAGGGAGCACCGTGGAGAAGACAGTGGCCCCTGCAGAATGCTCT
SEQ ID NO: 376

>N49P67
HEAVY CHAIN

*QVRLVQSGPVMRKPGASVRISCETS**GFAFLDHIVHWVRRAPGRGFEWMGWVKTIGGVV**DYAPHLRGR*
*ISVTRDVFSETVFLDLSRLTSGDTAMYFC**SKAAAPDEAFPLEF**WGQGTQVIVSS*ASYKGPSNFPLAPSS
KSTSGGTAALGCLVKDYFPEPVTVSWNSGALTSGVHTFPAVLQSSGLYSLSSVVTVPSSSLGTQTY
ICNVNHKPSNTKVDKRVEPKSCDKTHTCPPCPAPELLGGPSVFLFPPKPKDTLMISRTPEVTCVVVD
VSHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSPGK
SEQ ID NO: 377

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

```
CAGGTGCGACTTGTGCAGTCTGGTCCCGTGATGAGAAAGCCTGGGGCCTCAGTGAGAATTTCT
TGCGAGACATCTGGATTCGCCTTCTTGGACCACATTGTCCACTGGGTGCGGCGGGCCCCTGGA
CGCGGCTTTGAATGGATGGGTTGGGTTAAGACCATTGGGGGTGTCGTTGATTATGCACCCCAC
CTTAGGGGCAGGATCTCCGTGACGAGAGACGTCTTTAGTGAAACCGTCTTTCTGGACTTGAGT
CGACTGACGTCTGGCGACACGGCGATGTATTTTTGTTCTAAGGCCGCCGCCCCTGACGAAGCC
TTCCCCCTTGAATTTTGGGGCCAGGGGACCCAAGTCATCGTCTCCTCGGCCTCCACCAAGGGC
CCATCGGTCTTCCCCCTGGCACCCTCCTCCAAGAGCACCTCTGGGGGCACAGCGGCCCTGGGC
TGCCTGGTCAAGGACTACTTCCCCGAACCGGTGACGGTGTCGTGGAACTCAGGCGCCCTGACC
AGCGGCGTGCACACCTTCCCGGCTGTCCTACAGTCCTCAGGACTCTACTCCCTCAGCAGCGTG
GTGACCGTGCCCTCCAGCAGCTTGGGCACCCAGACCTACATCTGCAACGTGAATCACAAGCCC
AGCAACACCAAGGTGGACAAGAGAGTTGAGCCCAAATCTTGTGACAAAACTCACACATGCCCA
CCGTGCCCAGCACCTGAACTCCTGGGGGACCGTCAGTCTTCCTCTTCCCCCCAAAACCCAA
GGACACCCTCATGATCTCCCGGACCCCTGAGGTCACATGCGTGGTGGTGGACGTGAGCCACGA
AGACCCTGAGGTCAAGTTCAACTGGTACGTGGACGGCGTGGAGGTGCATAATGCCAAGACAA
AGCCGCGGGAGGAGCAGTACAACAGCACGTACCGGGTGGTCAGCGTCCTCACCGTCCTGCAC
CAGGACTGGCTGAATGGCAAGGAGTACAAGTGCAAGGTCTCCAACAAAGCCCTCCCAGCCCC
CATCGAGAAAACCATCTCCAAAGCCAAAGGGCAGCCCCGAGAACCACAGGTGTACACCCTGC
CCCCATCCCGGGAGGAGATGACCAAGAACCAGGTCAGCCTGACCTGCCTGGTCAAAGGCTTC
TATCCCAGCGACATCGCCGTGGAGTGGGAGAGCAATGGGCAGCCGGAGAACAACTACAAGAC
CACGCCTCCCGTGCTGGACTCCGACGGCTCCTTCTTCCTCTACAGCAAGCTCACCGTGGACAA
GAGCAGGTGGCAGCAGGGGAACGTCTTCTCATGCTCCGTGATGCATGAGGCTCTGCACAACC
ACTACACGCAGAAGAGCCTCTCCCTGTCTCCGGGTAAA
SEQ ID NO: 378
```

LIGHT CHAIN

*QAALTQPASVSGSPGQSVTISCLYA*NVD*ICWYQLHPGRAPKLLIL*DNN*KRPSGVSSRFSGSKSGTTASLTIS
DLQADDEAEYHC*SSTTF*FGGGTRLTVLS*QPKAAPSVTLFPPSSEELQANKATLVCLVSDFYPGAVTV
AWKADGSPVKVGVETTKPSKQSNNKYAASSYLSLTPEQWKSHRSYSCRVTHEGSTVEKTVAPAE
CS
SEQ ID NO: 379

```
CAGGCTGCCCTGACTCAGCCCGCCTCCGTGTCCGGCTCTCCTGGACAGTCGGTCACCATTTCTT
GCCTTTATGCCAATGTGGATATCTGCTGGTATCAACTTCACCCGGGCAGAGCCCCCAAACTTC
TAATTCTTGACAATAATAAACGGCCCTCAGGAGTCTCTAGTCGCTTCTCCGGTTCCAAGTCTGG
CACCACGGCCTCCCTAACCATCTCTGACCTTCAGGCTGACGACGAGGCTGAATATCACTGCTC
TTCAACAACTTTTTTTGGCGGGGGGACCAGGTTGACCGTCGTAGCTCAGCCCAAGGCTGCCCC
CTCGGTCACTCTGTTCCCACCCTTCCTCTGAGGAGCTTCAAGCCAACAAGGCCACACTGGTGTG
TCTCGTAAGTGACTTCTACCCGGGAGCCGTGACAGTGGCCTGGAAGGCAGATGGCAGCCCCGT
CAAGGTGGGAGTGGAGACCACCAAACCCTCCAAACAAAGCAACAACAAGTATGCGGCCAGC
AGCTACCTGAGCCTGACGCCCGAGCAGTGGAAGTCCCACAGAAGCTACAGCTGCCGGGTCAC
GCATGAAGGGAGCACCGTGGAGAAGACAGTGGCCCCTGCAGAATGCTCT
SEQ ID NO: 380
```

>N49P68
HEAVY CHAIN

*HVQLRQSGTEAKKSGASVTISCETA*GFNFIDSV*IHWLRQAPGGGFQWMGW*IKPLRGGV*NYPHYLQGRI
SMTRDLSSDTVYMVLNRLTPADTGLYYC*AKGAFGGSSPFGF*WGQGTLLTVSP*ASYKGPSNFPLAPSSK
STSGGTAALGCLVKDYFPEPVTVSWNSGALTSGVHTFPAVLQSSGLYSLSSVVTVPSSSLGTQTYIC
NVNHKPSNTKVDKRVEPKSCDKTHTCPPCPAPELLGGPSVFLFPPKPKDTLMISRTPEVTCVVVDV
SHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPP
VLDSDGSFFLYSKLTVDKSRWQQGNVFSCSVMHEALHNHYTQKSLSLSPGK
SEQ ID NO: 381

```
CACGTGCAGTTGAGGCAGTCTGGGACTGAGGCGAAGAAGTCTGGGGCCTCGGTGACAATCTC
TTGTGAGACCGCTGGATTCAACTTCATCGACTCCGTCATACACTGGCTGCGCCAGGCCCCTGG
TGGGGGATTTCAGTGGATGGGGTGGATCAAGCCTCTTAGAGGTGGCGTCAATTATCCACATTA
TTTGCAGGGCAGAATCTCCATGACCCGGGACTTGTCCAGTGACACGGTTTACATGGTCTTAAA
TAGACTGACACCTGCCGACACAGGCCTTTATTACTGCGCGAAAGGGGCCTTTGGGGGGAGTTC
TCCCTTTGGCTTCTGGGGCCAGGGAACTCTGCTCACCGTCTCCCAGCCTCCACCAAGGGCCCC
ATCGGTCTTCCCCCTGGCACCCTCCTCCAAGAGCACCTCTGGGGGCACAGCGGCCCTGGGCTG
CCTGGTCAAGGACTACTTCCCCGAACCGGTGACGGTGTCGTGGAACTCAGGCGCCCTGACCAG
CGGCGTGCACACCTTCCCGGCTGTCCTACAGTCCTCAGGACTCTACTCCCTCAGCAGCGTGGT
GACCGTGCCCTCCAGCAGCTTGGGCACCCAGACCTACATCTGCAACGTGAATCACAAGCCCAG
CAACACCAAGGTGGACAAGAGAGTTGAGCCCAAATCTTGTGACAAAACTCACACATGCCCAC
```

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

CGTGCCCAGCACCTGAACTCCTGGGGGGACCGTCAGTCTTCCTCTTCCCCCCAAAACCCAAGG
ACACCCTCATGATCTCCCGGACCCCTGAGGTCACATGCGTGGTGGTGGACGTGAGCCACGAAG
ACCCTGAGGTCAAGTTCAACTGGTACGTGGACGGCGTGGAGGTGCATAATGCCAAGACAAAG
CCGCGGGAGGAGCAGTACAACAGCACGTACCGGGTGGTCAGCGTCCTCACCGTCCTGCACCA
GGACTGGCTGAATGGCAAGGAGTACAAGTGCAAGGTCTCCAACAAAGCCCTCCCAGCCCCCA
TCGAGAAAACCATCTCCAAAGCCAAAGGGCAGCCCCGAGAACCACAGGTGTACACCCTGCCC
CCATCCCGGGAGGAGATGACCAAGAACCAGGTCAGCCTGACCTGCCTGGTCAAAGGCTTCTA
TCCCAGCGACATCGCCGTGGAGTGGGAGAGCAATGGGCAGCCGGAGAACAACTACAAGACCA
CGCCTCCCGTGCTGGACTCCGACGGCTCCTTCTTCCTCTACAGCAAGCTCACCGTGGACAAGA
GCAGGTGGCAGCAGGGGAACGTCTTCTCATGCTCCGTGATGCATGAGGCTCTGCACAACCACT
ACACGCAGAAGAGCCTCTCCCTGTCTCCGGGTAAA
SEQ ID NO: 382

LIGHT CHAIN

*QSALSQPVSVSGSPGESITISCTEATTWYQQLPGKPPKLIIY*DVTN*RPSGISSRFSGSMSGRTASLTISGLQV
DDEGLYHC*ASREF**GGGTKLTVLSQPK*AAPSVTLFPPSSEELQANKATLVCLVSDFYPGAVTVAWK
ADGSPVKVGVETTKPSKQSNNKYAASSYLSLTPEQWKSHRSYSCRVTHEGSTVEKTVAPAECS
SEQ ID NO: 383

CAGTCTGCCCTGTCTCAGCCTGTCTCCGTGTCTGGGTCTCCTGGAGAGTCGATCACCATTTCCT
GTACTGAAGCCACCACCTGGTATCAACAACTCCCAGGCAAACCCCCCAAACTCATCATTTATG
ACGTGACCAACCGGCCCTCAGGCATTTCAAGTCGTTTCTCTGGCTCCATGTCTGGTCGCACGG
CCTCCCTGACAATCTCCGGTCTCCAGGTTGACGACGAGGGTCTCTATCACTGTGCCTCACGTG
AATTTTTCGGCGGGGGGACCAAGCTGACCGTCCTGAGTCAGCCCAAGGCTGCCCCCTCGGTCA
CTCTGTTCCCACCCTCCTCTGAGGAGCTTCAAGCCAACAAGGCCACACTGGTGTGTCTCGTAA
GTGACTTCTACCCGGGAGCCGTGACAGTGGCCTGGAAGGCAGATGGCAGCCCCGTCAAGGTG
GGAGTGGAGACCACCAAACCCTCCAAACAAAGCAACAACAAGTATGCGGCCAGCAGCTACCT
GAGCCTGACGCCCGAGCAGTGGAAGTCCCACAGAAGCTACAGCTGCCGGGTCACGCATGAAG
GGAGCACCGTGGAGAAGACAGTGGCCCCTGCAGAATGCTCT
SEQ ID NO: 384

>N49P69
HEAVY CHAIN

*HVQLMQSGTQAKKSGASVTISCETA*GFKFIDSVI*HWLRQAPGGGFQWMGW*IKPLGGAV**NYPPYLQGRI
SLTRDLSTDTIYMVLNGLTPADTGFYYC*AKGAFGGGSPFGF**WGQGTLLTVS*PASYKGPSNFPLAPSSKS
TSGGTAALGCLVKDYFPEPVTVSWNSGALTSGVHTFPAVLQSSGLYSLSSVVTVPSSSLGTQTYIC
NVNHKPSNTKVDKRVEPKSCDKTHTCPPCPAPELLGGPSVFLFPPKPKDTLMISRTPEVTCVVVDV
SHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPP
VLDSDGSFFLYSKLTVDKSRWQQGNVFSCSVMHEALHNHYTQKSLSLSPGK
SEQ ID NO: 385

CACGTGCAATTGATGCAGTCTGGGACTCAGGCGAAGAAGTCTGGGGCCTCGGTGACAATTTCT
TGTGAGACCGCTGGATTCAAGTTCATCGACTCCGTCATACACTGGCTGCGCCAGGCCCCTGGA
GGGGGATTTCAGTGGATGGGGTGGATCAAGCCTCTTGGAGGTGCCGTCAACTATCCACCCTAT
TTGCAGGGCAGGATCTCCTTGACCCGTGACTTGTCCACCGACACAATTTACATGGTCTTGAAT
GGACTGACACCTGCCGACACAGGCTTTTATTACTGCGCCAAAGGGGCCTTTGGGGGGGGTTCT
CCCTTTGGCTTCTGGGGCCAGGGGACTCTGCTCACCGTCTCCCCAGCCTCCACCAAGGGCCCA
TCGGTCTTCCCCCTGGCACCCTCCTCCAAGAGCACCTCTGGGGGCACAGCGGCCCTGGGCTGC
CTGGTCAAGGACTACTTCCCCGAACCGGTGACGGTGTCGTGGAACTCAGGCGCCCTGACCAGC
GGCGTGCACACCTTCCCGGCTGTCCTACAGTCCTCAGGACTCTACTCCCTCAGCAGCGTGGTG
ACCGTGCCCTCCAGCAGCTTGGGCACCCAGACCTACATCTGCAACGTGAATCACAAGCCCAGC
AACACCAAGGTGGACAAGAGAGTTGAGCCCAAATCTTGTGACAAAACTCACACATGCCCACC
GTGCCCAGCACCTGAACTCCTGGGGGGACCGTCAGTCTTCCTCTTCCCCCCAAAACCCAAGGA
CACCCTCATGATCTCCCGGACCCCTGAGGTCACATGCGTGGTGGTGGACGTGAGCCACGAAGA
CCCTGAGGTCAAGTTCAACTGGTACGTGGACGGCGTGGAGGTGCATAATGCCAAGACAAAGC
CGCGGGAGGAGCAGTACAACAGCACGTACCGGGTGGTCAGCGTCCTCACCGTCCTGCACCAG
GACTGGCTGAATGGCAAGGAGTACAAGTGCAAGGTCTCCAACAAAGCCCTCCCAGCCCCCAT
CGAGAAAACCATCTCCAAAGCCAAAGGGCAGCCCCGAGAACCACAGGTGTACACCCTGCCCC
CATCCCGGGAGGAGATGACCAAGAACCAGGTCAGCCTGACCTGCCTGGTCAAAGGCTTCTAT
CCCAGCGACATCGCCGTGGAGTGGGAGAGCAATGGGCAGCCGGAGAACAACTACAAGACCA
CGCCTCCCGTGCTGGACTCCGACGGCTCCTTCTTCCTCTACAGCAAGCTCACCGTGGACAAGA
GCAGGTGGCAGCAGGGGAACGTCTTCTCATGCTCCGTGATGCATGAGGCTCTGCACAACCACT
ACACGCAGAAGAGCCTCTCCCTGTCTCCGGGTAAA
SEQ ID NO: 386

TABLE 4-continued

List of mAb variants and the corresponding sequence and mutations. The amino acid sequence of the variants is determined based on the reference antibody sequence (see table 2, above for reference antibody sequences) and the mutations described in the table. See below amino acid sequences and corresponding oligonucleotide sequences.
Amino acid and nucleotide sequences of additional anti-HIV antibodies are shown below. Variable regions within the heavy and light chain in the amino acid sequence are italicized and changes to the amino acid sequence relative to a natural antibody sequence are underlined. CDR residues are in bold.

LIGHT CHAIN

*QSALSQPVSVSGSPGDSITISCFGATTWYQQLPGRPPKLIIYDVTNRPSGISGRFSGSMSGQKASLTISGLQ
VDDEGLYHCASREFGGGTKLTVLS*QPKAAPSVTLFPPSSEELQANKATLVCLVSDFYPGAVTVAW
KADGSPVKVGVETTKPSKQSNNKYAASSYLSLTPEQWKSHRSYSCRVTHEGSTVEKTVAPAECS
SEQ ID NO: 387

CAGTCTGCCCTGTCTCAGCCTGTCTCCGTGTCTGGGTCTCCTGGAGACTCGATCACCATTTCTT
GTTTTGGAGCCACCACCTGGTATCAACAACTCCCAGGCAGACCCCCCAAACTCATCATTTATG
ACGTGACTAACCGGCCCTCAGGCATTTCAGGTCGTTTCTCTGGCTCCATGTCTGGTCAAAAGG
CCTCCCTGACAATCTCCGGTCTCCAGGTTGACGACGAGGGTCTCTATCACTGCGCCTCACGTG
AATTTTTCGGCGGGGGGACCAAACTGACCGTCCTGAGTCAGCCCAAGGCTGCCCCCTCGGTCA
CTCTGTTCCCACCCTCCTCTGAGGAGCTTCAAGCCAACAAGGCCACACTGGTGTGTCTCGTAA
GTGACTTCTACCCGGGAGCCGTGACAGTGGCCTGGAAGGCAGATGGCAGCCCCGTCAAGGTG
GGAGTGGAGACCACCAAACCCTCCAAACAAAGCAACAACAAGTATGCGGCCAGCAGCTACCT
GAGCCTGACGCCCGAGCAGTGGAAGTCCCACAGAAGCTACAGCTGCCGGGTCACGCATGAAG
GGAGCACCGTGGAGAAGACAGTGGCCCCTGCAGAATGCTCT
SEQ ID NO: 388

>N49P70
HEAVY CHAIN

*HVQLRQSGTEAKKSGASVTISCETAGFNFIDSVIHWLRQAPGGGFQWMGWIKPLRGGVYPHYLQGRI
SMTRDLSSDTVYMVLNRLTPDDTGLYYCAKGAFGGSSPFGFWGQGTLLTVS*PASYKGPSNFPLAPSSK
STSGGTAALGCLVKDYFPEPVTVSWNSGALTSGVHTFPAVLQSSGLYSLSSVVTVPSSSLGTQTYIC
NVNHKPSNTKVDKRVEPKSCDKTHTCPPCPAPELLGGPSVFLFPPKPKDTLMISRTPEVTCVVVDV
SHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPP
VLDSDGSFFLYSKLTVDKSRWQQGNVFSCSVMHEALHNHYTQKSLSLSPGK
SEQ ID NO: 389

CACGTGCAGTTGAGGCAGTCTGGGACTGAGGCGAAGAAGTCTGGGGCCTCGGTGACAATCTC
TTGTGAGACCGCTGGATTCAACTTCATCGACTCCGTCATACACTGGCTGCGCCAGGCCCCTGG
TGGGGGATTTCAGTGGATGGGGTGGATCAAGCCTCTTAGAGGTGGCGTCAATTATCCACATTA
TTTGCAGGGCAGAATCTCCATGACCCGGGACTTGTCCAGTGACACGGTTTACATGGTCTTAAA
TAGACTGACACCTGACGACACAGGCCTTTACTACTGCGCGAAAGGGGCCTTTGGGGGAGTTC
TCCCCTTTGGCTTCTGGGGCCAGGGAACTCTGCTCACCGTCTCCCCAGCCTCCACCAAGGGCCC
ATCGGTCTTCCCCCTGGCACCCTCCTCCAAGAGCACCTCTGGGGGCACAGCGGCCCTGGGCTG
CCTGGTCAAGGACTACTTCCCCGAACCGGTGACGGTGTCGTGGAACTCAGGCGCCCTGACCAG
CGGCGTGCACACCTTCCCGGCTGTCCTACAGTCCTCAGGACTCTACTCCCTCAGCAGCGTGGT
GACCGTGCCCTCCAGCAGCTTGGGCACCCAGACCTACATCTGCAACGTGAATCACAAGCCCAG
CAACACCAAGGTGGACAAGAGAGTTGAGCCCAAATCTTGTGACAAAACTCACACATGCCCAC
CGTGCCCAGCACCTGAACTCCTGGGGGGACCGTCAGTCTTCCTCTTCCCCCCAAAACCCAAGG
ACACCCTCATGATCTCCCGGACCCCTGAGGTCACATGCGTGGTGGTGGACGTGAGCCACGAAG
ACCCTGAGGTCAAGTTCAACTGGTACGTGGACGGCGTGGAGGTGCATAATGCCAAGACAAAG
CCGCGGGAGGAGCAGTACAACAGCACGTACCGGGTGGTCAGCGTCCTCACCGTCCTGCACCA
GGACTGGCTGAATGGCAAGGAGTACAAGTGCAAGGTCTCCAACAAAGCCCTCCCAGCCCCCA
TCGAGAAAACCATCTCCAAAGCCAAAGGGCAGCCCCGAGAACCACAGGTGTACACCCTGCCC
CCATCCCGGGAGGAGATGACCAAGAACCAGGTCAGCCTGACCTGCCTGGTCAAAGGCTTCTA
TCCCAGCGACATCGCCGTGGAGTGGGAGAGCAATGGGCAGCCGGAGAACAACTACAAGACCA
CGCCTCCCGTGCTGGACTCCGACGGCTCCTTCTTCCTCTACAGCAAGCTCACCGTGGACAAGA
GCAGGTGGCAGCAGGGGAACGTCTTCTCATGCTCCGTGATGCATGAGGCTCTGCACAACCACT
ACACGCAGAAGAGCCTCTCCCTGTCTCCGGGTAAA
SEQ ID NO: 390

LIGHT CHAIN

*QSALSQPVSVSGSPGESITISCTEATTWYQQLPGRSPKLIIYDVTNRPSGISSRFSGSMSGRTASLTISGLQV
DDEGLYHCASREFFGGGTKLTVLS*QPKAAPSVTLFPPSSEELQANKATLVCLVSDFYPGAVTVAWK
ADGSPVKVGVETTKPSKQSNNKYAASSYLSLTPEQWKSHRSYSCRVTHEGSTVEKTVAPAECS
SEQ ID NO: 391

CAGTCTGCCCTGTCTCAGCCTGTCTCCGTGTCTGGGTCTCCTGGAGAGTCGATCACCATTTCCT
GTACTGAAGCCACCACCTGGTATCAACAACTCCCAGGGAGATCCCCCAAACTCATTATTTATG
ACGTGACCAACCGGCCCTCAGGCATTTCAAGTCGTTTCTCTGGCTCCATGTCTGGTCGCACGG
CCTCCCTGACAATCTCCGGTCTCCAGGTTGACGACGAGGGTCTCTATCACTGTGCCTCACGTG
AATTTTTCGGCGGGGGGACCAAGCTGACCGTCCTCAGTCAGCCCAAGGCTGCCCCCTCGGTCA
CTCTGTTCCCACCCTCCTCTGAGGAGCTTCAAGCCAACAAGGCCACACTGGTGTGTCTCGTAA

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV antibodies are shown below. Variable regions within the heavy and
light chain in the amino acid sequence are italicized and changes
to the amino acid sequence relative to a natural antibody
sequence are underlined. CDR residues are in bold.

```
GTGACTTCTACCCGGGAGCCGTGACAGTGGCCTGGAAGGCAGATGGCAGCCCCGTCAAGGTG
GGAGTGGAGACCACCAAACCCTCCAAACAAAGCAACAACAAGTATGCGGCCAGCAGCTACCT
GAGCCTGACGCCCGAGCAGTGGAAGTCCCACAGAAGCTACAGCTGCCGGGTCACGCATGAAG
GGAGCACCGTGGAGAAGACAGTGGCCCCTGCAGAATGCTCT
SEQ ID NO: 392
```

>N49P71
HEAVY CHAIN

*RVTLQQSGATVRQPGASVTVSCETS*GFTFIKYT*IHWVRQAPGQGLQWVGR*IHPRTGAV*KFAPIFQGKFS
MSRDLSRDTAYLGLTRLTLADTALFF*ARGAFEADLYGPTYPFHH*WGQGTQVTSAASTKGPSVFPL*
APSSKSTSGGTAALGCLVKDYFPEPVTVSWNSGALTSGVHTFPAVLQSSGLYSLSSVVTVPSSSLG
TQTYICNVNHKPSNTKVDKRVEPKSCDKTHTCPPCPAPELLGGPSVFLFPPKPKDTLMISRTPEVTC
VVVDVSHEDPEVKFNWYVDG̲VEVHNAKTKPREEQYNSTYRVVSVLTVLHQDWLNGKEYKCKV
SNKALPAPIEKTISKAKGQPREPQVYTLPPSREEMTKNQVSLTCLVKGFYPSDIAVEWESNGQPEN
NYKTTPPVLDSDGSFFLYSKLTVDKSRWQQGNV̲FS̲CSVMHEALHNHYTQKSLSLSPGK
SEQ ID NO: 393

```
CGTGTTACATTACAACAGTCTGGGGCTACAGTGAGGCAGCCTGGGGCCTCAGTCACCGTCTCC
TGCGAGACTTCTGGATTCACCTTCATCAAATATACCATTCACTGGGTGCGACAGGCCCCTGGA
CAGGGTCTTCAGTGGGTGGGAAGAATACACCCCCGAACCGGTGCCGTGAAGTTTGCACCGAT
ATTTCAGGGTAAATTTTCCATGAGTCGAGACTTGTCACGCGACACAGCCTACCTCGGATTGAC
CAGACTGACACTCGCCGACACGGCTCTATTTTTCTGTGCGAGGGGGGCCTTTGAGGCAGATTT
ATATGGGCCAACTTACCCCTTTCACCACTGGGGCAAGGAACCCAAGTCACCGTCTCCGCGGC
CTCCACCAAGGGCCCATCGGTCTTCCCCCTGGCACCCTCCTCCAAGAGCACCTCTGGGGGCAC
AGCGGCCTGGGCTGCCTGGTCAAGGACTACTTCCCCGAACCGGTGACGGTGTCGTGGAACTC
AGGCGCCCTGACCAGCGGCGTGCACACCTTCCCGGCTGTCCTACAGTCCTCAGGACTCTACTC
CCTCAGCAGCGTGGTGACCGTGCCCTCCAGCAGCTTGGGCACCCAGACCTACATCTGCAACGT
GAATCACAAGCCCAGCAACACCAAGGTGGACAAGAGAGTTGAGCCCAAATCTTGTGACAAAA
CTCACACATGCCCACCGTGCCCAGCACCTGAACTCCTGGGGGGACCGTCAGTCTTCCTCTTCC
CCCCAAAACCCAAGGACACCCTCATGATCTCCCGGACCCCTGAGGTCACATGCGTGGTGGTGG
ACGTGAGCCACGAAGACCCTGAGGTCAAGTTCAACTGGTACGTGGACGGCGTGGAGGTGCAT
AATGCCAAGACAAAGCCGCGGGAGGAGCAGTACAACAGCACGTACCGGGTGGTCAGCGTCCT
CACCGTCCTGCACCAGGACTGGCTGAATGGCAAGGAGTACAAGTGCAAGGTCTCCAACAAAG
CCCTCCCAGCCCCCATCGAGAAAACCATCTCCAAAGCCAAAGGGCAGCCCCGAGAACCACAG
GTGTACACCCTGCCCCCATCCCGGGAGGAGATGACCAAGAACCAGGTCAGCCTGACCTGCCT
GGTCAAAGGCTTCTATCCCAGCGACATCGCCGTGGAGTGGGAGAGCAATGGGCAGCCGGAGA
ACAACTACAAGACCACGCCTCCCGTGCTGGACTCCGACGGCTCCTTCTTCCTCTACAGCAAGC
TCACCGTGGACAAGAGCAGGTGGCAGCAGGGGAACGTCTTCTCATGCTCCGTGATGCATGAG
GCTCTGCACAACCACTACACGCAGAAGAGCCTCTCCCTGTCTCCGGGTAAA
SEQ ID NO: 394
```

LIGHT CHAIN

*SWALTQPASVSASPGQSVTMSCTGF*GSYNP*DSWYQQYPGKAPKLIIY*DDN*KRPSGVSDRFSASRLGSTSS
LTISNVQAADDAHYVC*ASFEF*FGGGTKLTVLSQPKAAPSNYLFPPSSEELQANKAYLNCLNSDFYPGA*
VTVAWKADGSPVKVGVETTKPSKQSNNKYAASSYLSLTPEQWKSHRSYSCRVTHEGSTVEKTVA
PAECS
SEQ ID NO: 395

```
TCCTGGGCCCTGACTCAACCCGCCTCCGTGTCTGCGTCTCCTGGGCAGTCGGTCACCATGTCCT
GCACTGGATTCGGAAGTTATAATCCTGACTCCTGGTACCAGCAATACCCAGGCAAAGCCCCCA
AACTCATCATTTATGATGACAATAAAAGACCCTCGGGGTCTCTGATCGCTTCTCTGCCTCCA
GACTTGGCAGCACATCTTCACTGACAATCTCTAACGTCCAGGCCGCTGACGACGCCCATTATG
TCTGCGCCTCCTTTGAGTTTTTCGGCGGGGGGACCAAGCTGACCGTCCTGAGTCAGCCCAAGG
CTGCCCCCTCGGTCACTCTGTTCCCACCCTCCTCTGAGGAGCTTCAAGCCAACAAGGCCACAC
TGGTGTGTCTCGTAAGTGACTTCTACCCGGGAGCCGTGACAGTGGCCTGGAAGGCAGATGGCA
GCCCCGTCAAGGTGGGAGTGGAGACCACCAAACCCTCCAAACAAAGCAACAACAAGTATGCG
GCCAGCAGCTACCTGAGCCTGACGCCCGAGCAGTGGAAGTCCCACAGAAGCTACAGCTGCCG
GGTCACGCATGAAGGGAGCACCGTGGAGAAGACAGTGGCCCCTGCAGAATGCTCT
SEQ ID NO: 396
```

>N49P72
HEAVY CHAIN

*HIQLLQSGPQVKKSGDTVRISCETS*GYNFVDSL*IHWVRQTPEKRLRWMGW*INPLQGGV*NYAPEFQGRI
RMTRDTFIDTVYVDLSGLTPADTAYYYC*ARGIDGNSYPFHF*WGHGTRVTVFSASYKGPSNFPEAPSSKS
TSGGTAALGCLVKDYFPEPVTVSWNSGALTSGVHTFPAVLQSSGLYSLSSVVTVPSSSLGTQTYIC*

TABLE 4-continued

List of mAb variants and the corresponding sequence and mutations.
The amino acid sequence of the variants is determined based on the
reference antibody sequence (see table 2, above for reference
antibody sequences) and the mutations described in the table. See
below amino acid sequences and corresponding oligonucleotide
sequences.
Amino acid and nucleotide sequences of additional anti-HIV anti-
bodies are shown below. Variable regions within the heavy and
light chain in the amino acid sequence are italicized and changes
to the amino acid sequence relative to a natural antibody
sequence are underlined. CDR residues are in bold.

NVNHKPSNTKVDKRVEPKSCDKTHTCPPCPAPELLGGPSVFLFPPKPKDTLMISRTPEVTCVVVDV
SHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPP
VLDSDGSFFLYSKLTVDKSRWQQGNVFSCSVMHEALHNHYTQKSLSLSPGK
SEQ ID NO: 397

CACATTCAGTTGCTACAGTCGGGGCCTCAAGTTAAGAAGTCTGGGGACACAGTGAGAATCTCC
TGTGAGACCTCTGGATATAATTTCGTCGACTCCCTTATCCACTGGGTCCGACAGACCCCGGAA
AAACGTCTCAGATGGATGGGCTGGATCAATCCTCTCCAAGGTGGTGTGAATTACGCGCCGGAA
TTTCAGGGCAGAATCAGGATGACCAGGGACACGTTTATAGACACAGTTTACGTGGACTTGAGC
GGACTGACACCGGCCGACACGGCCTATTATTACTGCGCGCGAGGGATCGATGGCAATTCTTAC
CCCTTTCATTTCTGGGGCCACGGAACCCGGGTCACCGTCTTCTCGGCCTCCACCAAGGGCCCA
TCGGTCTTCCCCCTGGCACCCTCCTCCAAGAGCACCTCTGGGGGCACAGCGGCCCTGGGCTGC
CTGGTCAAGGACTACTTCCCCGAACCGGTGACGGTGTCGTGGAACTCAGGCGCCCTGACCAGC
GGCGTGCACACCTTCCCGGCTGTCCTACAGTCCTCAGGACTCTACTCCCTCAGCAGCGTGGTG
ACCGTGCCCTCCAGCAGCTTGGGCACCCAGACCTACATCTGCAACGTGAATCACAAGCCCAGC
AACACCAAGGTGGACAAGAGAGTTGAGCCCAAATCTTGTGACAAAACTCACACATGCCCACC
GTGCCCAGCACCTGAACTCCTGGGGGGACCGTCAGTCTTCCTCTTCCCCCCAAAACCCAAGGA
CACCCTCATGATCTCCCGGACCCCTGAGGTCACATGCGTGGTGGTGGACGTGAGCCACGAAGA
CCCTGAGGTCAAGTTCAACTGGTACGTGGACGGCGTGGAGGTGCATAATGCCAAGACAAAGC
CGCGGGAGGAGCAGTACAACAGCACGTACCGGGTGGTCAGCGTCCTCACCGTCCTGCACCAG
GACTGGCTGAATGGCAAGGAGTACAAGTGCAAGGTCTCCAACAAAGCCCTCCCAGCCCCCAT
CGAGAAAACCATCTCCAAAGCCAAAGGGCAGCCCCGAGAACCACAGGTGTACACCCTGCCCC
CATCCCGGGAGGAGATGACCAAGAACCAGGTCAGCCTGACCTGCCTGGTCAAAGGCTTCTAT
CCCAGCGACATCGCCGTGGAGTGGGAGAGCAATGGGCAGCCGGAGAACAACTACAAGACCA
CGCCTCCCGTGCTGGACTCCGACGGCTCCTTCTTCCTCTACAGCAAGCTCACCGTGGACAAGA
GCAGGTGGCAGCAGGGGAACGTCTTCTCATGCTCCGTGATGCATGAGGCTCTGCACAACCACT
ACACGCAGAAGAGCCTCTCCCTGTCTCCGGGTAAA
SEQ ID NO: 398

LIGHT CHAIN
RFALTQPASVSGSPGQTITITCAGGSVSWFHFPPGKTPRLIIYESSKRPSGVSPRFSGSQSGSTASLIISGLQ
SDDEGTYFGSILEFFGRGTLLTVLSQPKAAPSVTLFPPSSEELQANKATLVCLVSDFYPGAVTVAWK
ADGSPVKVGVETTKPSKQSNNKYAASSYLSLTPEQWKSHRSYSCRVTHEGSTVEKTVAPAECS
SEQ ID NO: 399

CGATTTGCCCTGACTCAACCTGCCTCCGTGTCTGGGTCTCCTGGACAGACGATCACCATAACCT
GCGCTGGAGGCAGCGTCTCCTGGTTCCATTTCCCTCCAGGCAAAACCCCCAGACTCATTATTT
ATGAGTCTTCTAAGAGACCCTCAGGGGTCTCTCCTCGATTCTCTGGGTCCCAGTCTGGCAGCA
CGGCCTCCCTAATAATTTCTGGCCTCCAGTCTGATGACGAAGGGACATACTTCTGTTCTATTCT
TGAATTTTTCGGCAGAGGGACTCTTCTCACCGTCCTGAGTCAGCCCAAGGCTGCCCCCTCGGT
CACTCTGTTCCCACCCTCCTCTGAGGAGCTTCAAGCCAACAAGGCCACACTGGTGTGTCTCGT
AAGTGACTTCTACCCGGGAGCCGTGACAGTGGCCTGGAAGGCAGATGGCAGCCCCGTCAAGG
TGGGAGTGGAGACCACCAAACCCTCCAAACAAAGCAACAACAAGTATGCGGCCAGCAGCTAC
CTGAGCCTGACGCCCGAGCAGTGGAAGTCCCACAGAAGCTACAGCTGCCGGGTCACGCATGA
AGGGAGCACCGTGGAGAAGACAGTGGCCCCTGCAGAATGCTCT
SEQ ID NO: 400

Polypeptides

In some embodiments, the invention provides isolated polypeptides comprising an individual light chain or heavy chain described herein as well as antigen binding fragments thereof. Polypeptides (e.g., intact antibodies) comprising both a light chain and a heavy chain are also provided.

Also provided are polypeptides that comprise: a polypeptide comprising SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 289, 293, 297, 301, 305, 309, 313, 317, 321, 325, 329, 333, 337, 341, 345, 349, 353, 357, 361, 365, 369, 373, 377, 381, 385, 389, 393 or 397 or an antigen binding fragment thereof.

Also provided are polypeptides that comprise: a polypeptide comprising SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 155, 159, 163, 167, 171, 175, 179, 183, 187, 191, 195, 199, 203, 207, 211, 215, 219, 223, 227, 231, 235, 239, 243, 247, 251, 255, 259, 263, 267, 271, 275, 279, 283, 287, 291, 295, 299, 303, 307, 311, 315, 319, 323, 327, 331, 335, 339, 343, 347, 351, 355, 359, 363, 367, 371, 375, 379, 383, 387, 391, 395 or 399 or an antigen binding fragment thereof.

Also provided are polypeptides that comprise: a polypeptide having at least about 90% sequence identity to SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 289, 293, 297, 301, 305, 309, 313, 317, 321, 325, 329, 333, 337, 341, 345, 349, 353, 357, 361, 365, 369, 373, 377, 381, 385, 389, 393 or 397.

In some embodiments, the polypeptide comprises a polypeptide having at least about 95%, at least about 96%, at least about 97%, at least about 98%, or at least about 99% sequence identity to SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 289, 293, 297, 301, 305, 309, 313, 317, 321, 325, 329, 333, 337, 341, 345, 349, 353, 357, 361, 365, 369, 373, 377, 381, 385, 389, 393 or 397.

Also provided are polypeptides that comprise: a polypeptide having at least about 90% sequence identity to SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 155, 159, 163, 167, 171, 175, 179, 183, 187, 191, 195, 199, 203, 207, 211, 215, 219, 223, 227, 231, 235, 239, 243, 247, 251, 255, 259, 263, 267, 271, 275, 279, 283, 287, 291, 295, 299, 303, 307, 311, 315, 319, 323, 327, 331, 335, 339, 343, 347, 351, 355, 359, 363, 367, 371, 375, 379, 383, 387, 391, 395 or 399.

In some embodiments, the polypeptide comprises a polypeptide having at least about 95%, at least about 96%, at least about 97%, at least about 98%, or at least about 99% sequence identity to SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 155, 159, 163, 167, 171, 175, 179, 183, 187, 191, 195, 199, 203, 207, 211, 215, 219, 223, 227, 231, 235, 239, 243, 247, 251, 255, 259, 263, 267, 271, 275, 279, 283, 287, 291, 295, 299, 303, 307, 311, 315, 319, 323, 327, 331, 335, 339, 343, 347, 351, 355, 359, 363, 367, 371, 375, 379, 383, 387, 391, 395 or 399.

Polynucleotides

In some embodiments, the invention encompasses polynucleotides comprising polynucleotides that encode a polypeptide as described herein, such as a heavy chain or light chain sequence of an HIV antibody or a fragment of such a polypeptide. For example, the invention provides a polynucleotide comprising a nucleic acid sequence that encodes an antibody to gp120 or encodes a fragment of such an antibody. The polynucleotides of the invention can be in the form of RNA or in the form of DNA. DNA includes cDNA, genomic DNA, and synthetic DNA; and can be double-stranded or single-stranded, and if single stranded can be the coding strand or non-coding (anti-sense) strand.

In some embodiments, the polynucleotides are isolated. In certain embodiments, the polynucleotides are substantially pure.

In some embodiments, the invention provides a polynucleotide comprising a polynucleotide encoding a polypeptide comprising a sequence selected from the group consisting of SEQ ID NOS:1-76, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227,229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363. 365, 367, 369, 371, 373, 375, 377, 379, 381, 383, 385, 387, 389, 391, 393, 395 and 397.

In some embodiments, the invention provides a polynucleotide comprising a polynucleotide encoding a polypeptide comprising the heavy or light chain variable region found within a sequence selected from the group consisting of SEQ ID NOS:1-76, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227,229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363. 365, 367, 369, 371, 373, 375, 377, 379, 381, 383, 385, 387, 389, 391, 393, 395 and 397.

Also provided is a polynucleotide encoding a polypeptide having at least about 95%, at least about 96%, at least about 97%, at least about 98%, or at least about 99% sequence identity to SEQ ID NOS:1-76, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227,229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363. 365, 367, 369, 371, 373, 375, 377, 379, 381, 383, 385, 387, 389, 391, 393, 395 or 397.

The invention further provides a polynucleotide comprising a sequence selected from the group consisting of SEQ ID NOS:77-152, 154, 156, 158, 160, 162, 164, 166, 168, 170, 172, 174, 176, 178, 180, 182, 184, 186, 188, 190, 192, 194, 196, 198, 200 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398 and 400.

Also provided is a polynucleotide having at least 70%, 75%, 80%, 85%, 86%, 87%, 88%, 89%, 90%, 91%, 92%, 93%, 94%, 95%, 96%, 97%, 98%, or 99% sequence identity to SEQ ID NOS:77-152, 154, 156, 158, 160, 162, 164, 166, 168, 170, 172, 174, 176, 178, 180, 182, 184, 186, 188, 190, 192, 194, 196, 198, 200 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, or 400.

In some embodiments the polynucleotides comprise the coding sequence for the mature polypeptide fused in the same reading frame to a polynucleotide which aids, for example, in expression and secretion of a polypeptide from a host cell (e.g. a leader sequence which functions as a secretory sequence for controlling transport of a polypeptide from the cell). The polypeptide having a leader sequence is a preprotein and can have the leader sequence cleaved by the host cell to form the mature form of the polypeptide. The polynucleotides can also encode for a proprotein which is the mature protein plus additional 5' amino acid residues. A mature protein having a prosequence is a proprotein and is an inactive form of the protein. Once the prosequence is cleaved an active mature protein remains.

In certain embodiments the polynucleotides comprise the coding sequence for the mature polypeptide fused in the same reading frame to a marker sequence that allows, for example, for purification of the encoded polypeptide. For example, the marker sequence can be a hexa-histidine tag supplied by a pQE-9 vector to provide for purification of the mature polypeptide fused to the marker in the case of a bacterial host, or the marker sequence can be a hemagglutinin (HA) tag derived from the influenza hemagglutinin protein when a mammalian host (e.g. COS-7 cells) is used.

The present invention further relates to variants of the hereinabove described polynucleotides encoding, for example, fragments, analogs, and derivatives.

The polynucleotide variants can contain alterations in the coding regions, non-coding regions, or both. In some embodiments the polynucleotide variants contain alterations which produce silent substitutions, additions, or deletions, but do not alter the properties or activities of the encoded polypeptide. In some embodiments, nucleotide variants are produced by silent substitutions due to the degeneracy of the genetic code. Polynucleotide variants can be produced for a variety of reasons, e.g., to optimize codon expression for a particular host (change codons in the human mRNA to those preferred by a bacterial host such as E. coli).

Vectors and cells comprising the polynucleotides described herein are also provided. The term "vector" means a construct, which is capable of delivering, and expressing, one or more gene(s) or sequence(s) of interest in a host cell. Examples of vectors include, but are not limited to, viral vectors, naked DNA or RNA expression vectors, plasmid, cosmid or phage vectors, DNA or RNA expression vectors associated with cationic condensing agents, DNA or RNA expression vectors encapsulated in liposomes, and certain eukaryotic cells, such as producer cells. "Vector" also includes shuttle and expression vectors. In some embodiments, the vector is a plasmid construct and also includes an origin of replication (e.g., the ColE1 origin of replication) and a selectable marker (e.g., ampicillin or tetracycline resistance), for replication and selection, respectively. An "expression vector" refers to a vector that contains the necessary control sequences or regulatory elements for expression of the antibodies including antibody fragments of the invention, in bacterial or eukaryotic cells.

Methods

The anti-HIV antibodies of the invention are useful in a variety of applications including, but not limited to, therapeutic treatment methods, such as the treatment, cure, functional cure, or prevention of HIV infection. The methods of use may be in vitro, ex vivo, or in vivo methods.

In some embodiments, the antibodies disclosed herein may be used as neutralizing antibodies, passively administered or given via gene therapies.

In one aspect, the anti-HIV antibodies are useful for detecting the presence of HIV in a biological sample. The term "detecting" as used herein encompasses quantitative or qualitative detection. In certain embodiments, a biological sample comprises a cell or tissue.

Certain other methods can be used to detect binding of anti-HIV antibodies to antigens such as gp120. Such methods include, but are not limited to, antigen-binding assays that are well known in the art, such as western blots, radioimmunoassays, ELISA (enzyme linked immunosorbent assay), "sandwich" immunoassays, immunoprecipitation assays, fluorescent immunoassays, protein A immunoassays, and immunohistochemistry (IHC).

In certain embodiments, the antibodies are labeled. Labels include, but are not limited to, labels or moieties that are detected directly (such as fluorescent, chromophoric, electron-dense, chemiluminescent, and radioactive labels), as well as moieties, such as enzymes or ligands, that are detected indirectly, e.g., through an enzymatic reaction or molecular interaction.

In certain embodiments, the antibodies are immobilized on an insoluble matrix. Immobilization entails separating the antibody from any antigen that remains free in solution. This conventionally is accomplished by either insolubilizing the antibody before the assay procedure, as by adsorption to a water-insoluble matrix or surface (Bennich et al., U.S. Pat. No. 3,720,760), or by covalent coupling (for example, using glutaraldehyde cross-linking), or by insolubilizing the antibody after formation of a complex between the antibody and antigen, e.g., by immunoprecipitation.

The present invention provides for methods of treating or preventing HIV infection comprising administering a therapeutically effective amount of an antibody as described herein to a subject (e.g., a subject in need of treatment). In some embodiments, the subject is a human.

Subjects at risk for HIV-related diseases or disorders include patients who have come into contact with an infected person or who have been exposed to HIV-1 in some other way. Administration of a prophylactic agent can occur prior to the manifestation of symptoms characteristic of HIV-1-related disease or disorder, such that a disease or disorder is prevented or, alternatively, delayed in its progression.

In some embodiments of the present invention, the subject is administered effective amounts of more than one anti-HIV antibody of the invention. In some embodiments, the subject is administered a pharmaceutical composition comprising a combination of antibodies of the invention, in order to treat or prevent HIV infection. In some embodiments, a combination of antibodies are administered, which can include a combination comprising any one or more of N49P6 or an antigen binding fragment thereof, N49P7 or an antigen binding fragment thereof, N49P7.1 or an antigen binding fragment thereof, N49P9 or an antigen binding fragment thereof, or N49P11 or an antigen binding fragment thereof. In some embodiments, the antibody comprises the VH and VL regions of N49P6, N49P7, N49P7.1, N49P9, or N49P11 as described herein. In some embodiments, the antibody comprises the CDRs of the VH and VL regions of N49P6, N49P7, N49P7.1, N49P9, or N49P11 as described herein. In some embodiments, the combination comprises i) N49P6 or an antigen binding fragment thereof, ii) N49P7 or an antigen binding fragment thereof and iii) N49P11 or an antigen binding fragment thereof. In some embodiments, the subject is administered a polyclonal composition of antibodies comprising any one of i) N49P6 or an antigen binding fragment thereof, ii) N49P7 or an antigen binding fragment thereof and/or iii) N49P11 or an antigen binding fragment thereof in combination with one or more natural or variant antibodies as described herein. Such combinations can be selected according to the desired immunity. The composition can further include one or more other broadly neutralizing antibodies.

Methods for preventing an increase in HIV-1 virus titer, virus replication, virus proliferation or an amount of an HIV-1 viral protein in a subject are further provided. In one embodiment, a method includes administering to the subject an amount of an anti-HIV antibody effective to prevent an increase in HIV-1 titer, virus replication or an amount of an HIV-1 protein of one or more HIV strains or isolates in the subject.

For in vivo treatment of human patients, the patient is usually administered or provided a pharmaceutical formulation including an anti-HIV antibody of the invention. When used for in vivo therapy, the antibodies of the invention are administered to the patient in therapeutically effective amounts (i.e., amounts that eliminate or reduce the patient's viral burden). The antibodies can be administered to a human patient, in accord with known methods, such as intravenous administration, e.g., as a bolus or by continuous infusion over a period of time, by intramuscular, intraperitoneal, intracerobrospinal, subcutaneous, intra-articular, intrasynovial, intrathecal, oral, topical, or inhalation routes. The antibodies may be administered parenterally, when possible, at the target cell site, or intravenously. Intravenous or subcutaneous administration of the antibody is preferred in certain embodiments. Therapeutic compositions of the invention are administered to a patient or subject systemically, parenterally, or locally.

For parenteral administration, the antibodies can be formulated in a unit dosage injectable form (solution, suspension, emulsion) in association with a pharmaceutically acceptable, parenteral vehicle. Examples of such vehicles are water, saline, Ringer's solution, dextrose solution, and 5% human serum albumin. Nonaqueous vehicles such as fixed oils and ethyl oleate are also used. Liposomes are used as carriers. The vehicle contains minor amounts of additives such as substances that enhance isotonicity and chemical stability, e.g., buffers and preservatives. The antibodies are typically formulated in such vehicles at concentrations of about 1 mg/ml to 10 mg/ml.

The dose and dosage regimen depends upon a variety of factors readily determined by a physician, such as the nature of the infection and the characteristics of the particular cytotoxic agent or growth inhibitory agent conjugated to the antibody (when used), e.g., its therapeutic index, the patient, and the patient's history. Generally, a therapeutically effective amount of an antibody is administered to a patient. In particular embodiments, the amount of antibody administered is in the range of about 0.1 mg/kg to about 20 mg/kg of patient body weight. Depending on the type and severity of the infection, about 0.1 mg/kg to about 20 mg/kg body weight (e.g., about 0.1-15 mg/kg/dose) of antibody is an initial candidate dosage for administration to the patient, whether, for example, by one or more separate administrations, or by continuous infusion. The progress of this therapy is readily monitored by conventional methods and assays and based on criteria known to the physician or other persons of skill in the art.

Antibodies of the invention can be coupled to a drug for delivery to a treatment site or coupled to a detectable label to facilitate imaging of a site comprising cells of interest, such as cells infected with HIV. Methods for coupling antibodies to drugs and detectable labels are well known in the art, as are methods for imaging using detectable labels. Labeled antibodies may be employed in a wide variety of assays, employing a wide variety of labels. Detection of the formation of an antibody-antigen complex between an antibody of the invention and an epitope of interest (an HIV epitope) can be facilitated by attaching a detectable substance to the antibody. Suitable detection means include the use of labels such as radionucleotides, enzymes, coenzymes, fluorescers, chemiluminescers, chromogens, enzyme substrates or co-factors, enzyme inhibitors, prosthetic group complexes, free radicals, particles, dyes, and the like. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material is luminol; examples of bioluminescent materials include luciferase, luciferin, and aequorin; and examples of suitable radioactive material include $^{125}$I, $^{131}$I, $^{35}$S, or .sup.3H. Such labeled reagents may be used in a variety of well-known assays, such as radioimmunoassays, enzyme immunoassays, e.g., ELISA, fluorescent immunoassays, and the like.

The antibodies can be tagged with such labels by known methods. For instance, coupling agents such as aldehydes, carbodiimides, dimaleimide, imidates, succinimides, bid-diazotized benzadine and the like are used to tag the antibodies with the above-described fluorescent, chemiluminescent, and enzyme labels. An enzyme is typically combined with an antibody using bridging molecules such as carbodiimides, periodate, diisocyanates, glutaraldehyde and the like. Various labeling techniques are described in Morrison, *Methods in Enzymology* 32b, 103 (1974), Syvanen et al., *J. Biol. Chem.* 284, 3762 (1973) and Bolton and Hunter, Biochem J. 133, 529(1973).

In one embodiment, the antibodies can be administered as immunoconjugates, conjugated to a second molecule. For example, the second molecule can be a toxin, a label, a radioisotope, a drug, or a chemical compound.

An antibody according to the invention may be conjugated to a therapeutic moiety such as a cytotoxin, a therapeutic agent, or a radioactive metal ion or radioisotope. Examples of radioisotopes include, but are not limited to, I-131, I-123, I-125, Y-90, Re-188, Re-186, At-211, Cu-67, Bi-212, Bi-213, Pd-109, Tc-99, In-111, and the like. Such antibody conjugates can be used for modifying a given biological response; the drug moiety is not to be construed as limited to classical chemical therapeutic agents. For example, the drug moiety may be a protein or polypeptide possessing a desired biological activity. Such proteins may include, for example, a toxin such as abrin, ricin A, pseudomonas exotoxin, or diphtheria toxin, TLR agonists (such as TLR7 agonist), or monomethylauristatin E.

Other therapeutic regimens can be combined with the administration of the anti-HIV antibody of the present invention. The combined administration includes co-administration, using separate formulations or a single pharmaceutical formulation, and consecutive administration in either order, wherein preferably there is a time period while both (or all) active agents simultaneously exert their biological activities. Preferably such combined therapy results in a synergistic therapeutic effect.

For any application, the antibody, antigen binding fragment, or nucleic acid encoding the antibody or antigen binding fragment can be combined with anti-retroviral therapy. Antiretroviral drugs are broadly classified by the phase of the retrovirus life-cycle that the drug inhibits. The disclosed antibodies can be administered in conjunction with nucleoside analog reverse-transcriptase inhibitors (such as zidovudine, didanosine, zalcitabine, stavudine, lamivudine, abacavir, emtricitabine, entecavir, and apricitabine), nucleotide reverse transcriptase inhibitors (such as tenofovir and adefovir), non-nucleoside reverse transcriptase inhibitors (such as efavirenz, nevirapine, delavirdine, etravirine, and rilpivirine), protease inhibitors (such as saquinavir, ritonavir, indinavir, nelfinavir, amprenavir, lopinavir, fosamprenavir, atazanavir, tipranavir, and darunavir), entry or fusion inhibitors (such as maraviroc and enfuvirtide), maturation inhibitors, (such as bevirimat and vivecon), or a broad spectrum inhibitors, such as natural antivirals. In some examples, a disclosed antibody or active fragment thereof or nucleic acids encoding such is administered in conjunction with IL-15, or conjugated to IL-15.

Single or multiple administrations of the compositions including the antibody, antigen binding fragment, or nucleic acid encoding the antibody or antigen binding fragment, that are disclosed herein, are administered depending on the dosage and frequency as required and tolerated by the patient. In any event, the composition should provide a sufficient quantity of at least one of the antibodies disclosed herein to effectively treat the patient. The dosage can be administered once, but may be applied periodically until either a therapeutic result is achieved or until side effects warrant discontinuation of therapy.

One approach to administration of nucleic acids is direct administration with plasmid DNA, such as with a mammalian expression plasmid. The nucleotide sequence encoding the disclosed antibody, or antibody binding fragments thereof, can be placed under the control of a promoter to increase expression. Another approach is to administer the nucleic acids in the form of mRNA.

In some embodiments, the subject is administered cells that are engineered to express the anti-HIV antibody. In some embodiments, the cells are engineered immune cells, such as B cells. In some embodiments, the cells are engineered, autologous cells.

In another approach to using nucleic acids, an anti-HIV antibody, or antibody binding fragment thereof can also be expressed by attenuated viral hosts or vectors or bacterial vectors. Recombinant vaccinia virus, adeno-associated virus (AAV), herpes virus, retrovirus, cytomegalovirus or other viral vectors can be used to express the antibody. For example, vaccinia vectors and methods useful protocols are described in U.S. Pat. No. 4,722,848. BCG (Bacillus Calmette Guerin) provides another vector for expression of the disclosed antibodies (see Stover, Nature 351:456-460, 1991).

Compositions

The present invention also encompasses compositions comprising one or more antibodies of the invention. In certain embodiments, the compositions are pharmaceutical compositions. In some embodiments, formulations are prepared for storage and use by combining an antibody with a pharmaceutically acceptable vehicle (e.g. carrier, excipient) (*Remington, The Science and Practice of Pharmacy* 20*th Edition* Mack Publishing, 2000). Suitable pharmaceutically acceptable vehicles include, but are not limited to, nontoxic buffers such as phosphate, citrate, and other organic acids; salts such as sodium chloride; antioxidants including ascorbic acid and methionine; preservatives (e.g. octadecyldimethylbenzyl ammonium chloride; hexamethonium chloride; benzalkonium chloride; benzethonium chloride; phenol, butyl or benzyl alcohol; alkyl parabens, such as methyl or propyl paraben; catechol; resorcinol; cyclohexanol; 3-pentanol; and m-cresol); low molecular weight polypeptides (e.g. less than about 10 amino acid residues); proteins such as serum albumin, gelatin, or immunoglobulins; hydrophilic polymers such as polyvinylpyrrolidone; amino acids such as glycine, glutamine, asparagine, histidine, arginine, or lysine; carbohydrates such as monosacchandes, disaccharides, glucose, mannose, or dextrins; chelating agents such as EDTA; sugars such as sucrose, mannitol, trehalose or sorbitol; salt-forming counter-ions such as sodium; metal complexes (e.g. Zn-protein complexes); and non-ionic surfactants such as TWEEN or polyethylene glycol (PEG).

For the treatment or prevention of HIV, the appropriate dosage of an antibody or combination of antibodies of the present invention can depend on a variety of factors, such as the severity and course of the disease, the responsiveness of the disease, whether the antibody or agent is administered for therapeutic or preventative purposes, previous therapy, patient's clinical history, and so on all at the discretion of the treating physician. The antibody or agent can be administered one time or over a series of treatments lasting from several days to several months, or until a cure is effected or a diminution of the disease state is achieved. The administering physician can easily determine optimum dosages, dosing methodologies and repetition rates. In certain embodiments, dosage is from 0.01 µg to 100 mg per kg of body weight, and can be given once or more daily, weekly, monthly or yearly. In certain embodiments, the antibody or combination of antibodies is given once every two weeks or once every three weeks. In certain embodiments, the dosage of the antibody is from about 0.1 mg to about 20 mg per kg of body weight. The treating physician can estimate repetition rates for dosing based on measured residence times and concentrations of the drug in bodily fluids or tissues.

Effective dosages and schedules for administering embodiments of the present invention can be determined empirically. In some embodiments, and effective amount of one or more antibodies are administered to neutralize, treat, prevent or eradicate HIV infection. In some embodiments, compositions comprising one or more nucleic acid molecules of the invention are administered to the subject. In some embodiments, genetic constructs capable of inducing production of antibodies of the present invention may be administered to a patient in need thereof.

Controlled-release parenteral formulations can be made as implants, oily injections, or as particulate systems. For a broad overview of protein delivery systems see, Banga, A. J., Therapeutic Peptides and Proteins: Formulation, Processing, and Delivery Systems, Technomic Publishing Company, Inc., Lancaster, Pa., (1995). Particulate systems include microspheres, microparticles, microcapsules, nanocapsules, nano spheres, and nanoparticles. Microcapsules contain the therapeutic protein, such as a cytotoxin or a drug, as a central core. In microspheres the therapeutic is dispersed throughout the particle. Particles, microspheres, and microcapsules smaller than about 1 µm are generally referred to as nanoparticles, nanospheres, and nanocapsules, respectively. Capillaries have a diameter of approximately 5 .mu.m so that only nanoparticles are administered intravenously. Microparticles are typically around 100 µm in diameter and are administered subcutaneously or intramuscularly. See, for example, Kreuter, J., Colloidal Drug Delivery Systems, J. Kreuter, ed., Marcel Dekker, Inc., New York, N.Y., pp. 219-342 (1994); and Tice & Tabibi, Treatise on Controlled Drug Delivery, A. Kydonieus, ed., Marcel Dekker, Inc. New York, N.Y., pp. 315-339, (1992).

Polymers can be used for ion-controlled release of the antibody compositions disclosed herein. Various degradable and nondegradable polymeric matrices for use in controlled drug delivery are known in the art (Langer, Accounts Chem. Res. 26:537-542, 1993). For example, the block copolymer, polaxamer 407, exists as a viscous yet mobile liquid at low temperatures but forms a semisolid gel at body temperature. It has been shown to be an effective vehicle for formulation and sustained delivery of recombinant interleukin-2 and urease (Johnston et al., Pharm. Res. 9:425-434, 1992; and Pec et al., J. Parent. Sci. Tech. 44(2):58-65, 1990). Alternatively, hydroxyapatite has been used as a microcarrier for controlled release of proteins (Ijntema et al., Int. J. Pharm. 112:215-224, 1994). In yet another aspect, liposomes are used for controlled release as well as drug targeting of the lipid-capsulated drug (Betageri et al., Liposome Drug Delivery Systems, Technomic Publishing Co., Inc., Lancaster, Pa. (1993)). Numerous additional systems for controlled delivery of therapeutic proteins are known (see U.S. Pat. Nos. 5,055,303; 5,188,837; 4,235,871; 4,501,728; 4,837,028; 4,957,735; 5,019,369; 5,055,303; 5,514,670; 5,413,797; 5,268,164; 5,004,697; 4,902,505; 5,506,206; 5,271,961; 5,254,342 and 5,534,496).

In some embodiments, the compositions of the invention may be injectable suspensions, solutions, sprays, lyophilized powders, syrups, elixirs and the like. Any suitable form of composition may be used. To prepare such a composition, a nucleic acid or vector of the invention, having the desired degree of purity, is mixed with one or more pharmaceutically acceptable carriers and/or excipients. The carriers and excipients must be "acceptable" in the sense of being compatible with the other ingredients of the composition. Acceptable carriers, excipients, or stabilizers are nontoxic to recipients at the dosages and concentrations employed, and include, but are not limited to, water, saline, phosphate buffered saline, dextrose, glycerol, ethanol, or combinations thereof, buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™ PLURONICS™ or polyethylene glycol (PEG).

The compositions can be designed to introduce the antibodies, nucleic acids or expression vectors to a desired site of action and release it at an appropriate and controllable rate. Methods of preparing controlled-release formulations are known in the art. For example, controlled release preparations can be produced by the use of polymers to complex or absorb the immunogen and/or immunogenic composition. A controlled-release formulations can be prepared using appropriate macromolecules (for example, polyesters, polyamino acids, polyvinyl, pyrrolidone, ethylenevinylacetate, methylcellulose, carboxymethylcellulose, or protamine sulfate) known to provide the desired controlled release characteristics or release profile. Another possible method to control the duration of action by a controlled-release preparation is to incorporate the active ingredients into particles of a polymeric material such as, for example, polyesters, polyamino acids, hydrogels, polylactic acid, polyglycolic acid, copolymers of these acids, or ethylene vinylacetate copolymers. Alternatively, instead of incorporating these active ingredients into polymeric particles, it is possible to entrap these materials into microcapsules prepared, for example, by coacervation techniques or by interfacial polymerization, for example, hydroxymethylcellulose or gelatin-microcapsule and poly-(methylmethacrylate) microcapsule, respectively, in colloidal drug delivery systems (for example, liposomes, albumin microspheres, microemulsions, nano-particles and nanocapsules) or in macroemulsions. Such techniques are disclosed in New Trends and Developments in Vaccines, Voller et al. (eds.), University Park Press, Baltimore, Md., 1978 and Remington's Pharmaceutical Sciences, 16th edition.

The compositions can be administered using any suitable delivery method including, but not limited to, intramuscular, intravenous, intradermal, mucosal, and topical delivery. Such techniques are well known to those of skill in the art. More specific examples of delivery methods are intramuscular injection, intradermal injection, and subcutaneous injection. However, delivery need not be limited to injection methods. Further, delivery of DNA to animal tissue has been achieved by cationic liposomes (Watanabe et al., (1994) Mol. Reprod. Dev. 38:268-274; and WO 96/20013), direct injection of naked DNA into animal muscle tissue (Robinson et al., (1993) Vaccine 11:957-960; Hoffman et al., (1994) Vaccine 12: 1529-1533; Xiang et al., (1994) Virology 199: 132-140; Webster et al., (1994) Vaccine 12: 1495-1498; Davis et al., (1994) Vaccine 12: 1503-1509; and Davis et al., (1993) Hum. Mol. Gen. 2: 1847-1851), or intradermal injection of DNA using "gene gun" technology (Johnston et al., (1994) Meth. Cell Biol. 43:353-365). Alternatively, delivery routes can be oral, intranasal or by any other suitable route. Delivery also be accomplished via a mucosal surface such as the anal, vaginal or oral mucosa.

Dosing schedules (or regimens) can be readily determined for the particular subject and composition. Hence, the composition can be administered one or more times to the subject. Preferably, there is a set time interval between separate administrations of the composition. While this interval varies for every subject, typically it can range from 10 days to several weeks, and is often 2, 4, 6 or 8 weeks. In some embodiments, the interval can be typically from 2 to 6 weeks.

The compositions of the invention can be administered alone, or can be co-administered, or sequentially administered, with other HIV immunogens and/or HIV immunogenic compositions, e.g., with "other" immunological, antigenic or vaccine or therapeutic compositions thereby providing multivalent or "cocktail" or combination compositions of the invention and methods of employing them. Again, the ingredients and manner (sequential or co-administration) of administration, as well as dosages can be determined taking into consideration such factors as the age, sex, weight, species and condition of the particular subject, and the route of administration.

Kits

The present invention also includes kits useful in performing diagnostic and prognostic assays using the antibodies of the present invention. Kits of the invention include a suitable container comprising an HIV-1 antibody of the invention in either labeled or unlabeled form. In addition, when the antibody is supplied in a labeled form suitable for an indirect binding assay, the kit further includes reagents for performing the appropriate indirect assay. For example, the kit includes one or more suitable containers including enzyme substrates or derivatizing agents, depending on the nature of the label. Control samples and/or instructions are also included.

SAMPLE EMBODIMENTS

This section describes exemplary compositions and methods of the invention, presented without limitation, as a series of paragraphs, some or all of which may be alphanumerically designated for clarity and efficiency. Each of these paragraphs can be combined with one or more other paragraphs, and/or with disclosure from elsewhere in this application, including the materials incorporated by reference, in any suitable manner. Some of the paragraphs below expressly refer to and further limit other paragraphs, providing without limitation examples of some of the suitable combinations.

1. An isolated anti-HIV antibody that is capable of neutralizing at least 95% of the HIV pseudoviruses listed in Table 1 with an IC50 value of less than 50 µg/mL.
2. An isolated anti-HIV antibody that is capable of neutralizing at least 99% of the HIV pseudoviruses listed in Table 1 with an IC50 value of less than 50 µg/mL.
3. An isolated anti-HIV antibody that is capable of neutralizing 100% of the HIV pseudoviruses listed in Table 1 with an IC50 value of less than 50 µg/mL.
4. An isolated anti-HIV antibody that neutralizes 100% of the HIV clade B, G and D viruses listed in Table 1 with an IC50 value of less than 50 µg/mL.
5. The isolated anti-HIV antibody of any of paragraphs 1-4, wherein the anti-HIV antibody binds to a HIV gp120 epitope comprising outer domain loop D (which comprises 275-283), the CD4 binding loop (which comprises 354-371), the bridging sheet (which comprises 427-439) and loop V5 (which comprises 455-463) and gp120 inner domain: helix alpha-1 of Layer 2 (comprising positions 96-106) and 469-480 (loop prior and helix alpha-5 of Layer 3).
6. The isolated anti-HIV antibody of any of paragraphs 1-5, wherein the anti-HIV antibody binds to a HIV gp120 Layer 2 residues W96, K97, E102, G124, Loop D residues E275, N276, T278, N279, N280, A281, K282, CD4 binding loop residues P364, S365, G366, G367, D368, I371, bridging sheet residues W427, Q428, G429, Loop V5 residues T455, R456, D457, G458, G459, A460, N461, T463, and Layer 3 residues R469, P470, G471, G472, G473, N474, K476, D477, R480.
7. The isolated anti-HIV antibody of any of paragraphs 1-6, wherein the antibody has a Kd for BaL-gp120 of at least about $2.456 \times 10^{-8}$ M as determined by surface plasmon resonance.
8. The isolated anti-HIV antibody of any of paragraphs 1-7, wherein the antibody has a Kd for BaL-gp120 of at least about $1.59 \times 10^{-8}$ M as determined by surface plasmon resonance.
9. The isolated anti-HIV antibody of any of paragraphs 1-8, wherein the antibody has a Kd for BaL-gp120 of at least about $1.562 \times 10^{-8}$ M as determined by surface plasmon resonance.
10. The isolated anti-HIV antibody of any of paragraphs 1-9, wherein the antibody has a Kd for BaL-gp120 of at least about $1.143 \times 10^{-9}$ M as determined by surface plasmon resonance.
11. The isolated anti-HIV antibody of any of paragraphs 1-10, wherein the antibody has Kd for BaL-gp120 of at least about $8.602 \times 10^{-10}$ M as determined by surface plasmon resonance.
12. The isolated anti-HIV antibody of any of paragraphs 1-11, wherein the anti-HIV antibody further neutralizes strain CNE5 (clade CRF01_AE) with an IC50 value of less than 50 µg/mL.
13. The isolated anti-HIV antibody of any of paragraphs 1-12, wherein the antibody is capable of neutralizing HIV pseudoviruses listed in Table 1 with a median IC50 value of less than 0.5 µg/mL.
14. The isolated anti-HIV antibody of any of paragraphs 1-13, wherein the anti-HIV antibody neutralizes at least 50%, at least 55%, at least 60%, at least 65%, at least 70%, at least 75%, at least 80%, at least 85%, at least 90%, at least 95%, or at least 99% of the HIV pseudoviruses listed in Table 1 with an IC50 value of less than about 1 µg/ml, between about 1-5 µg/ml or greater than about 5 µg/ml.
15. The isolated anti-HIV antibody of any of paragraphs 1-14, wherein the anti-HIV antibody neutralizes at least about 86.4% of the HIV pseudoviruses listed in Table 1 with an IC50 value of less than 1 µg/mL.
16. The isolated anti-HIV antibody of paragraph 15, wherein the antibody is N49P7 or an antigen binding fragment thereof.
17. The isolated anti-HIV antibody of paragraph 16, wherein the antibody comprises the VH and VL regions of N49P7 as described herein.
18. The isolated anti-HIV antibody of paragraph 17, wherein the antibody comprises the CDRs of the VH and VL regions of N49P7 as described herein.
19. The isolated anti-HIV antibody of any of paragraphs 1-14, wherein the anti-HIV antibody neutralizes at least 88.7% of the HIV pseudoviruses listed in Table 1 with an IC50 value of less than 1 µg/mL.
20. The isolated anti-HIV antibody of paragraph 19, wherein the antibody is N49P7.1 or an antigen binding fragment thereof.
21. The isolated anti-HIV antibody of paragraph 20, wherein the antibody comprises the VH and VL regions of N49P7.1 as described herein.
22. The isolated anti-HIV antibody of paragraph 21, wherein the antibody comprises the CDRs of the VH and VL regions of N49P7.1 as described herein.
23. The isolated anti-HIV antibody of any of paragraphs 1-22, wherein the anti-HIV antibody neutralizes at least 84.5% of the HIV pseudoviruses listed in Table 1 with an IC50 value of less than 1 µg/mL.
24. The isolated anti-HIV antibody of paragraph 23, wherein the antibody is N49P7.2 or an antigen binding fragment thereof.
25. The isolated anti-HIV antibody of any of paragraph 24, wherein the antibody comprises the VH and VL regions of N49P7.2 as described herein.
26. The isolated anti-HIV antibody of any of paragraph 25, wherein the antibody comprises the CDRs of the VH and VL regions of N49P7.2 as described herein.
27. The isolated anti-HIV antibody of any of paragraphs 1-14, wherein the anti-HIV antibody neutralizes at least 71.8% of the HIV pseudoviruses listed in Table 1 with an IC50 value of less than 1 µg/mL.
28. The isolated anti-HIV antibody of paragraph 27, wherein the antibody is N49P6 or an antigen binding fragment thereof.
29. The isolated anti-HIV antibody of paragraph 28, wherein the antibody comprises the VH and VL regions of N49P6 as described herein.
30. The isolated anti-HIV antibody of paragraph 29, wherein the antibody comprises the CDRs of the VH and VL regions of N49P6 as described herein.
31. The isolated anti-HIV antibody of any of paragraphs 1-14, wherein the anti-HIV antibody neutralizes at least 93.3% of the HIV pseudoviruses listed in Table 1 with an IC50 value of less than 1 µg/mL.

32. The isolated anti-HIV antibody of paragraph 31, wherein the antibody is N49P9 or an antigen binding fragment thereof.
33. The isolated anti-HIV antibody of paragraph 32, wherein the antibody comprises the VH and VL regions of N49P9 as described herein.
34. The isolated anti-HIV antibody of paragraph 33, wherein the antibody comprises the CDRs of the VH and VL regions of N49P9 as described herein.
35. The isolated anti-HIV antibody of any of paragraphs 1-14, wherein the anti-HIV antibody neutralizes at least 91.1% of the HIV pseudoviruses listed in Table 1 with an IC50 value of less than 1 µg/mL.
36. The isolated anti-HIV antibody of paragraph 35, wherein the antibody is N49P9.1 or an antigen binding fragment thereof.
37. The isolated anti-HIV antibody of paragraph 36, wherein the antibody comprises VH and VL regions of N49P9.1 as described herein.
38. The isolated anti-HIV antibody of paragraph 37, wherein the antibody comprises the CDRs of the VH and VL regions of N49P9.1 as described herein.
39. The isolated anti-HIV antibody of any of paragraphs 1-14, wherein the anti-HIV antibody neutralizes at least 41.9% of the HIV pseudoviruses listed in Table 1 with an IC50 value of less than 1 µg/mL.
40. The isolated anti-HIV antibody of paragraph 39, wherein the anti-HIV antibody is N49P11 or an antigen binding fragment thereof.
41. The isolated anti-HIV antibody of paragraph 40, wherein the anti-HIV antibody comprises the VH and VL regions of N49P11 as described herein.
42. The isolated anti-HIV antibody of paragraph 41, wherein the anti-HIV antibody comprises the CDRs of the VH and VL regions of N49P11 as described herein.
43. The isolated anti-HIV antibody of any of paragraphs 1-14, wherein the anti-HIV antibody neutralizes at least 2.1% of the HIV pseudoviruses listed in Table 1 with an IC50 value of less than 1 µg/mL.
44. The isolated anti-HIV antibody of paragraph 43, wherein the anti-HIV antibody is N49P18.1 or an antigen binding fragment thereof.
45. The isolated anti-HIV antibody of paragraph 44, wherein the anti-HIV antibody comprises the VH and VL regions of N49P18.1 as described herein.
46. The isolated anti-HIV antibody of paragraph 45, wherein the anti-HIV antibody comprises the CDRs of the VH and VL regions of N49P18.1 as described herein.
47. The isolated anti-HIV antibody of any of paragraphs 1-14, wherein the anti-HIV antibody neutralizes at least 60% of the HIV pseudoviruses listed in Table 1 with an IC50 value of less than 1 µg/mL.
48. The isolated anti-HIV antibody of paragraph 47, wherein the anti-HIV antibody is N49P19 or an antigen binding fragment thereof.
49. The isolated anti-HIV antibody of paragraph 48, wherein the anti-HIV antibody comprises the VH and VL regions of N49P19 as described herein.
50. The isolated anti-HIV antibody of paragraph 49, wherein the anti-HIV antibody comprises the CDRs of the VH and VL regions of N49P19 as described herein.
51. The isolated anti-HIV antibody of any of paragraphs 1-14, wherein the anti-HIV antibody neutralizes at least 58.3% of the HIV pseudoviruses listed in Table 1 with an IC50 value of less than 1 µg/mL.
52. The isolated anti-HIV antibody of paragraph 51, wherein the anti-HIV antibody is N49P22 or an antigen binding fragment thereof.
53. The isolated anti-HIV antibody of paragraph 52, wherein the anti-HIV antibody comprises the VH and VL regions of N49P22 as described herein.
54. The isolated anti-HIV antibody of paragraph 53, wherein the anti-HIV antibody comprises the CDRs of the VH and VL regions of N49P22 as described herein.
55. The isolated anti-HIV antibody of any of paragraphs 1-14, wherein the anti-HIV antibody neutralizes at least 88.6% of the HIV pseudoviruses listed in Table 1 with an IC50 value of less than 1 µg/mL.
56. The isolated anti-HIV antibody of paragraph 55, wherein the anti-HIV antibody is N49P23 or an antigen binding fragment thereof.
57. The isolated anti-HIV antibody of paragraph 56, wherein the anti-HIV antibody comprises the VH and VL regions of N49P23 as described herein.
58. The isolated anti-HIV antibody of paragraph 57, wherein the anti-HIV antibody comprises the CDRs of the VH and VL regions of N49P23 as described herein.
59. The isolated anti-HIV antibody of any of paragraphs 1-58, wherein anti-HIV antibody is selected from the group consisting of:
   a. an antibody comprising a heavy chain variable region, wherein CDR H1 comprises GYDFIDYV (SEQ ID NO:401), CDR H2 comprises MNPSGGGT (SEQ ID NO:402) and CDR H3 comprises VRDRANGSGRRRFESVNWFLDL (SEQ ID NO:403); and a light chain variable region, wherein CDR L1 comprises HNY, CDR L2 comprises DFN and CDR L3 comprises WAFEN (SEQ ID NO:404);
   b. an antibody comprising a heavy chain variable region, wherein CDR H1 comprises GYKFPDYI (SEQ ID NO:405), CDR H2 comprises INPMGGQV (SEQ ID NO:406) and CDR H3 comprises VRDRSNGSGRRFESSN (SEQ ID NO:407); and a light chain variable region, wherein CDR L1 comprises HNL, CDR L2 comprises DFN and CDR L3 comprises WAYEA (SEQ ID NO:408);
   c. an antibody comprising a heavy chain variable region, wherein CDR H1 comprises GYTFTDYL (SEQ ID NO:409), CDR H2 comprises MNPVYGQV (SEQ ID NO:410) and CDR H3 comprises VRDTGDGSRRHFDSINWFLDL (SEQ ID NO:411); and a light chain variable region, wherein CDR L1 comprises HNY, CDR L2 comprises DFD and CDR L3 comprises WAFEA (SEQ ID NO:412);
   d. an antibody comprising a heavy chain variable region, wherein CDR H1 comprises GYTFTDYV (SEQ ID NO:413), CDR H2 comprises IDPPYGQV (SEQ ID NO:414) and CDR H3 comprises VRDRSNGWGKRFESSNWFLDL (SEQ ID NO:415); and a light chain variable region, wherein CDR L1 comprises HNL, CDR L2 comprises DFN and CDR L3 comprises WAYEA (SEQ ID NO:408);
   e. an antibody comprising a heavy chain variable region, wherein CDR H1 comprises GYTFVDYF (SEQ ID NO:416), CDR H2 comprises MDPLNGRP (SEQ ID NO:417) and CDR H3 comprises VRDKSNGSGRRFDSSNWFLDL (SEQ ID NO:418); and a light chain variable region, wherein CDR L1 comprises HNY, CDR L2 comprises DFN and CDR L3 comprises WAYDA (SEQ ID NO:419);
   f. an antibody comprising a heavy chain variable region, wherein CDR H1 comprises GYTFSDYI (SEQ ID NO:420), CDR H2 comprises MNPMGGQV (SEQ ID NO:421) and CDR H3 comprises VRDRSNGSGKRFESSNWFLDL (SEQ ID NO:441); and a light chain variable region, wherein CDR L1 comprises HNL, CDR L2 comprises DFN and CDR L3 comprises WAYEV (SEQ ID NO:422);

g. an antibody comprising a heavy chain variable region, wherein CDR H1 comprises GYTFIDYI (SEQ ID NO:423), CDR H2 comprises IDPMNGRP (SEQ ID NO:424) and CDR H3 comprises VRDKSNGSGKRFDSSNWFLDL (SEQ ID NO:425); and a light chain variable region, wherein CDR L1 comprises HNY, CDR L2 comprises DFN and CDR L3 comprises WAYDA (SEQ ID NO:419);

h. an antibody comprising a heavy chain variable region, wherein CDR H1 comprises GYTFTDYI (SEQ ID NO:426), CDR H2 comprises MNPMGGRT (SEQ ID NO:427) and CDR H3 comprises VRDKSNGSGKRFDSSNWFLDL (SEQ ID NO:425); and a light chain variable region, wherein CDR L1 comprises HNL, CDR L2 comprises DFN and CDR L3 comprises WAYEA (SEQ ID NO:408);

i. an antibody comprising a heavy chain variable region, wherein CDR H1 comprises GYTFVDYL (SEQ ID NO:428), CDR H2 comprises MDPMNGRP (SEQ ID NO:429) and CDR H3 comprises VRDKSGGSGKLFDSSNWFLDL (SEQ ID NO:430); and a light chain variable region, wherein CDR L1 comprises HNY, CDR L2 comprises DFN and CDR L3 comprises WAYDA (SEQ ID NO:419);

j. an antibody comprising a heavy chain variable region, wherein CDR H1 comprises GYTFTDYV (SEQ ID NO:413), CDR H2 comprises INPGYGQV (SEQ ID NO:431) and CDR H3 comprises VRDRSNGWGKRFESSNWFLDL (SEQ ID NO:415); and a light chain variable region, wherein CDR L1 comprises HNL, CDR L2 comprises DFN and CDR L3 comprises WAYEA (SEQ ID NO:408);

k. an antibody comprising a heavy chain variable region, wherein CDR H1 comprises GYTFTDYV (SEQ ID NO:413), CDR H2 comprises MDPSYGQV (SEQ ID NO:432) and CDR H3 comprises VRDRSHGSGRQFESSNWFLDL (SEQ ID NO:433); and a light chain variable region, wherein CDR L1 comprises HNL, CDR L2 comprises DFN and CDR L3 comprises WAYEA (SEQ ID NO:408);

l. an antibody comprising a heavy chain variable region, wherein CDR H1 comprises GYTFTDYV (SEQ ID NO:413), CDR H2 comprises MDPSFGQM (SEQ ID NO:434) and CDR H3 comprises VRDRSHGSGRLFESSNWFLDL (SEQ ID NO:435); and a light chain variable region, wherein CDR L1 comprises HNL, CDR L2 comprises DFN and CDR L3 comprises WAYEA (SEQ ID NO:408);

m. an antibody comprising a heavy chain variable region, wherein CDR H1 comprises GYRFTDYV (SEQ ID NO:436), CDR H2 comprises MDPSFGRM (SEQ ID NO:437) and CDR H3 comprises VRDRSHGSGRLFESSNWFLDL (SEQ ID NO:435); and a light chain variable region, wherein CDR L1 comprises HNL, CDR L2 comprises DFN and CDR L3 comprises WAYEA (SEQ ID NO:408);

n. an antibody comprising a heavy chain variable region, wherein CDR H1 comprises GYTFIDYV (SEQ ID NO:438), CDR H2 comprises MDPTYGRM (SEQ ID NO:439) and CDR H3 comprises VRDRSHGSGRLFESSNWFLDL (SEQ ID NO:435); and a light chain variable region, wherein CDR L1 comprises HNL, CDR L2 comprises DFN and CDR L3 comprises WAYEA (SEQ ID NO:408);

o. an antibody comprising a heavy chain variable region, wherein CDR H1 comprises GYRFLDYI (SEQ ID NO:440), CDR H2 comprises MNPMGGQV (SEQ ID NO:421) and CDR H3 comprises VRDRSNGSGKRFESSNWFLDL (SEQ ID NO:441); and a light chain variable region, wherein CDR L1 comprises HNL, CDR L2 comprises DFN and CDR L3 comprises WAYEA (SEQ ID NO:408);

p. an antibody comprising a heavy chain variable region, wherein CDR H1 comprises GYKFMDQL (SEQ ID NO:442), CDR H2 comprises MNPTYGQV (SEQ ID NO:443) and CDR H3 comprises ARGPSGENYPFHY (SEQ ID NO:444); and a light chain variable region, wherein CDR L1 comprises RHII (SEQ ID NO:445), CDR L2 comprises DDD and CDR L3 comprises NTYEF (SEQ ID NO:446);

q. an antibody comprising a heavy chain variable region, wherein CDR H1 comprises GYNFVDSR (SEQ ID NO:447), CDR H2 comprises INPLQGGV (SEQ ID NO:448) and CDR H3 comprises ARGIDGKSYPFHF (SEQ ID NO:449); and a light chain variable region, wherein CDR L1 comprises S, CDR L2 comprises ESS and CDR L3 comprises SILEF (SEQ ID NO:450);

r. an antibody comprising a heavy chain variable region, wherein CDR H1 comprises GYTFTTHHGHF (SEQ ID NO:500), CDR H2 comprises MNPMTGQM (SEQ ID NO:462) and CDR H3 comprises ARGDFGQNYPFHY (SEQ ID NO:463); and a light chain variable region, wherein CDR L1 comprises NRYL (SEQ ID NO:464), CDR L2 comprises DDN and CDR L3 comprises ASYER (SEQ ID NO:465);

s. an antibody comprising a heavy chain variable region, wherein CDR H1 comprises GYNFMDQF (SEQ ID NO:466), CDR H2 comprises MNPIYGQV (SEQ ID NO:467) and CDR H3 comprises ARGPSGENYPFHY (SEQ ID NO:444); and a light chain variable region, wherein CDR L1 comprises RHII (SEQ ID NO:445), CDR L2 comprises DDD and CDR L3 comprises NTYEF (SEQ ID NO:446);

t. an antibody comprising a heavy chain variable region, wherein CDR H1 comprises GYNFVDSR (SEQ ID NO:447), CDR H2 comprises INPLHGGV (SEQ ID NO:468) and CDR H3 comprises ARGIDGKSYPFHF (SEQ ID NO:449); and a light chain variable region, wherein CDR L1 comprises S, CDR L2 comprises ESS and CDR L3 comprises SILEF (SEQ ID NO:450);

u. an antibody comprising a heavy chain variable region, wherein CDR H1 comprises GYTFTKYF (SEQ ID NO:451), CDR H2 comprises IHPRTGAV (SEQ ID NO:452) and CDR H3 comprises ARGAFEADSYGSSYPFHH (SEQ ID NO:453); and a light chain variable region, wherein CDR L1 comprises GNYNP (SEQ ID NO:454), CDR L2 comprises EDN and CDR L3 comprises ASFEF (SEQ ID NO:455);

v. an antibody comprising a heavy chain variable region, wherein CDR H1 comprises GYTFTKYT (SEQ ID NO:456), CDR H2 comprises IHPRTGAV (SEQ ID NO:452) and CDR H3 comprises ARGAFEADLSGPTYPFHH (SEQ ID NO:457); and a light chain variable region, wherein CDR L1 comprises GNYNP (SEQ ID NO:454), CDR L2 comprises EDN and CDR L3 comprises ASFEF (SEQ ID NO:455);

w. an antibody comprising a heavy chain variable region, wherein CDR H1 comprises GFNFIDSV (SEQ ID NO:458), CDR H2 comprises IKPLRGAV (SEQ ID NO:459) and CDR H3 comprises AKGAFRGGSPFGF (SEQ ID NO:460); and a light chain variable region, wherein CDR L1 comprises DVT and CDR L2 comprises ASREF (SEQ ID NO:461);

x. an antibody comprising a heavy chain variable region, wherein CDR H1 comprises GYTFTSYF (SEQ ID NO:469), CDR H2 comprises INPLHGAV (SEQ ID NO:470) and CDR H3 comprises TRGIVADGWPYGH (SEQ ID NO:471); and a light chain variable region, wherein CDR L1 comprises S, CDR L2 comprises EGA and CDR L3 comprises SSLQF (SEQ ID NO:472);

y. an antibody comprising a heavy chain variable region, wherein CDR H1 comprises GFTFIDHI (SEQ ID NO:473), CDR H2 comprises IKPLRGAV (SEQ ID NO:459) and CDR H3 comprises CKAAAPEEAFPLQY (SEQ ID NO:474); and a light chain variable region, wherein CDR L1 comprises NVD, CDR L2 comprises DNN and CDR L3 comprises SSRTF (SEQ ID NO:475);

z. an antibody comprising a heavy chain variable region, wherein CDR H1 comprises GFKFIDHI (SEQ ID NO:476), CDR H2 comprises IKPLGGVA (SEQ ID NO:477) and CDR H3 comprises CKAAAPDEAFPLEY (SEQ ID NO:478); and a light chain variable region, wherein CDR L1 comprises NVD, CDR L2 comprises DNN and CDR L3 comprises SSTTF (SEQ ID NO:479);

aa. an antibody comprising a heavy chain variable region, wherein CDR H1 comprises GFAFLDH (SEQ ID NO:480), CDR H2 comprises VKTIGGVV (SEQ ID NO:481) and CDR H3 comprises SKAAAPDEAFPLEF (SEQ ID NO:482); and a light chain variable region, wherein CDR L1 comprises NVD, CDR L2 comprises DNN and CDR L3 comprises SSTTF (SEQ ID NO:479);

bb. an antibody comprising a heavy chain variable region, wherein CDR H1 comprises GFKFTEYF (SEQ ID NO:483), CDR H2 comprises LNPLRGAV (SEQ ID NO:484) and CDR H3 comprises ARAVFNEAFPFDY (SEQ ID NO:485); and a light chain variable region, wherein CDR L1 comprises VS, CDR L2 comprises DGD and CDR L3 comprises ASREF (SEQ ID NO:461);

cc. an antibody comprising a heavy chain variable region, wherein CDR H1 comprises GFKFIDHI (SEQ ID NO:476), CDR H2 comprises IKPLGGVA (SEQ ID NO:477) and CDR H3 comprises CKAAAPDEAFPLEY (SEQ ID NO:478); and a light chain variable region, wherein CDR L1 comprises NVD, CDR L2 comprises DND and CDR L3 comprises SSTTF (SEQ ID NO:479);

dd. an antibody comprising a heavy chain variable region, wherein CDR H1 comprises GFAFLDHI (SEQ ID NO:486), CDR H2 comprises VKTIGGVV (SEQ ID NO:481) and CDR H3 comprises SKAAAPDEAFPLEF (SEQ ID NO:482); and a light chain variable region, wherein CDR L1 comprises NVD, CDR L2 comprises DNN and CDR L3 comprises SSTTF (SEQ ID NO:479);

ee. an antibody comprising a heavy chain variable region, wherein CDR H1 comprises GFKFIDSV (SEQ ID NO:487), CDR H2 comprises IKPLGGAV (SEQ ID NO:488) and CDR H3 comprises AKGAFGGGSPFGF (SEQ ID NO:489); and a light chain variable region, wherein CDR L1 comprises DVT and CDR L2 comprises ASREF (SEQ ID NO:461);

ff. an antibody comprising a heavy chain variable region, wherein CDR H1 comprises GFNFIDSV (SEQ ID NO:458), CDR H2 comprises IKPLRGGV (SEQ ID NO:490) and CDR H3 comprises AKGAFGGSSPFGF (SEQ ID NO:491); and a light chain variable region, wherein CDR L1 comprises DVT and CDR L2 comprises ASREF (SEQ ID NO:461);

gg. an antibody comprising a heavy chain variable region, wherein CDR H1 comprises GFTFIKYT (SEQ ID NO:492), CDR H2 comprises IHPRTGAV (SEQ ID NO:452) and CDR H3 comprises ARGAFEADLYGPTYPFHH (SEQ ID NO:493); and a light chain variable region, wherein CDR L1 comprises GSYNP (SEQ ID NO:494), CDR L2 comprises DDN and CDR L3 comprises ASFEF (SEQ ID NO:455);

hh. an antibody comprising a heavy chain variable region, wherein CDR H1 comprises GYNFVDSL (SEQ ID NO:495), CDR H2 comprises INPLQGGV (SEQ ID NO:448) and CDR H3 comprises ARGIDGNSYPFHF (SEQ ID NO:496); and a light chain variable region, wherein CDR L1 comprises S, CDR L2 comprises ESS and CDR L3 comprises SILEF (SEQ ID NO:450);

ii. an antibody comprising a heavy chain variable region, wherein CDR H1 comprises GYRFPDYI (SEQ ID NO:497), CDR H2 comprises MNPTYGQV (SEQ ID NO:443) and CDR H3 comprises VRDRSNGSGKRFESSNWFLDL (SEQ ID NO:441); and a light chain variable region, wherein CDR L1 comprises HNL, CDR L2 comprises DFN and CDR L3 comprises WAYEA (SEQ ID NO:408);

jj. an antibody comprising a heavy chain variable region, wherein CDR H1 comprises GYRFPDYI (SEQ ID NO:497), CDR H2 comprises MNPMGGQV (SEQ ID NO:421) and CDR H3 comprises VRDRSNGSGKRFESSNWFLDL (SEQ ID NO:441); and a light chain variable region, wherein CDR L1 comprises HNY, CDR L2 comprises DFN and CDR L3 comprises WAFEN (SEQ ID NO:404);

kk. an antibody comprising a heavy chain variable region, wherein CDR H1 comprises GYRFPDYI (SEQ ID NO:497), CDR H2 comprises MNPMGGQV (SEQ ID NO:421) and CDR H3 comprises VRDRSNGSGKRFESSNWFLDL (SEQ ID NO:441); and a light chain variable region, wherein CDR L1 comprises HNY, CDR L2 comprises DFD and CDR L3 comprises WAFEA (SEQ ID NO:412);

ll. an antibody comprising a heavy chain variable region, wherein CDR H1 comprises GYRFPDYI (SEQ ID NO:497), CDR H2 comprises MNPMGGQV (SEQ ID NO:421) and CDR H3 comprises VRDRSNGSGKRFESSNWFLDL (SEQ ID NO:441); and a light chain variable region, wherein CDR L1 comprises RHII (SEQ ID NO:445), CDR L2 comprises DDD and CDR L3 comprises NTYEF (SEQ ID NO:446);

mm. an antibody comprising a heavy chain variable region, wherein CDR H1 comprises GYRFPDYI (SEQ ID NO:497), CDR H2 comprises MNPMGGQV (SEQ ID NO:421) and CDR H3 comprises VRDRSNGSGKRFESSNWFLDL (SEQ ID NO:441); and a light chain variable region, wherein CDR L1 comprises HNY, CDR L2 comprises DFN and CDR L3 comprises WAYDA (SEQ ID NO:419);

nn. an antibody comprising a heavy chain variable region, wherein CDR H1 comprises GYRFPDYI (SEQ ID NO:497), CDR H2 comprises MNPMGGQV (SEQ ID NO:421) and CDR H3 comprises VRDRSNGSGKRFESSNWFLDL (SEQ ID NO:441); and a light chain variable region, wherein CDR L1 comprises HNL, CDR L2 comprises DFN and CDR L3 comprises WAYEA (SEQ ID NO:408);

oo. an antibody comprising a heavy chain variable region, wherein CDR H1 comprises GYKFMDQL (SEQ ID NO:442), CDR H2 comprises MNPTYGQV (SEQ ID NO:443) and CDR H3 comprises VRDRSNGSGKRFESSN (SEQ ID NO:498); and a light chain variable region, wherein CDR L1 comprises RHII (SEQ ID NO:445), CDR L2 comprises DDD and CDR L3 comprises NTYEF (SEQ ID NO:446);

pp. an antibody comprising a heavy chain variable region, wherein CDR H1 comprises GYKFMDQL (SEQ ID NO:442), CDR H2 comprises (SEQ ID NO:443) and CDR H3 comprises VRDRSNGSGKRFESSNWFLDL (SEQ ID NO:441); and a light chain variable region, wherein CDR L1 comprises RHII (SEQ ID NO:445), CDR L2 comprises DDD and CDR L3 comprises NTYEF (SEQ ID NO:446); and qq. an antibody comprising a heavy chain variable region, wherein CDR H1 comprises GYRFLDYI (SEQ ID NO:440), CDR H2 comprises MNPMGGQV (SEQ ID NO:421) and CDR H3 comprises VRDRSNGSGKRFESSNWFLDL (SEQ ID NO:441); and a light chain variable region, wherein CDR L1 comprises HNL, CDR L2 comprises DFN and CDR L3 comprises WAYEA (SEQ ID NO:408).

60. The isolated anti-HIV antibody of any of claims 1-59, wherein the anti-HIV antibody comprises a heavy chain or an antigen binding fragment thereof and a light chain or an antigen binding fragment thereof, wherein the heavy chain or antigen binding fragment thereof comprises a heavy chain variable (VH) region and the light chain or antigen binding fragment thereof comprises a light chain variable (VL) region; wherein the anti-HIV antibody is selected from the group consisting of an antibody:

a. wherein the VH region comprises amino acids 1-128 of SEQ ID NO:1 or a variant thereof comprising 1, 2, 3, or 4 conservative amino acid substitutions; wherein the VL region comprises amino acids 1-99 of SEQ ID NO:2 or a variant thereof comprising 1, 2, 3, or 4 conservative amino acid substitutions;

b. wherein the VH region comprises amino acids 1-127 of SEQ ID NO:3 or a variant thereof comprising 1, 2, 3, or 4 conservative amino acid substitutions; wherein the VL region comprises amino acids 1-99 of SEQ ID NO:4 or a variant thereof comprising 1, 2, 3, or 4 conservative amino acid substitutions;

c. wherein the VH region comprises amino acids 1-127 of SEQ ID NO:5 or a variant thereof comprising 1, 2, 3, or 4 conservative amino acid substitutions; wherein the VL region comprises amino acids 1-99 of SEQ ID NO:6 or a variant thereof comprising 1, 2, 3, or 4 conservative amino acid substitutions;

d. wherein the VH region comprises amino acids 1-128 of SEQ ID NO:7 or a variant thereof comprising 1, 2, 3, or 4 conservative amino acid substitutions; wherein the VL region comprises amino acids 1-99 of SEQ ID NO:8 or a variant thereof comprising 1, 2, 3, or 4 conservative amino acid substitutions;

e. wherein the VH region comprises amino acids 1-127 of SEQ ID NO:9 or a variant thereof comprising 1, 2, 3, or 4 conservative amino acid substitutions; wherein the VL region comprises amino acids 1-99 of SEQ ID NO:10 or a variant thereof comprising 1, 2, 3, or 4 conservative amino acid substitutions;

f. wherein the VH region comprises amino acids 1-127 of SEQ ID NO:11 or a variant thereof comprising 1, 2, 3, or 4 conservative amino acid substitutions; wherein the VL region comprises amino acids 1-99 of SEQ ID NO:12 or a variant thereof comprising 1, 2, 3, or 4 conservative amino acid substitutions;

g. wherein the VH region comprises amino acids 1-127 of SEQ ID NO:13 or a variant thereof comprising 1, 2, 3, or 4 conservative amino acid substitutions; wherein the VL region comprises amino acids 1-99 of SEQ ID NO:14 or a variant thereof comprising 1, 2, 3, or 4 conservative amino acid substitutions;

h. wherein the VH region comprises amino acids 1-127 of SEQ ID NO:15 or a variant thereof comprising 1, 2, 3, or 4 conservative amino acid substitutions; wherein the VL region comprises amino acids 1-99 of SEQ ID NO:16 or a variant thereof comprising 1, 2, 3, or 4 conservative amino acid substitutions;

i. wherein the VH region comprises amino acids 1-127 of SEQ ID NO:17 or a variant thereof comprising 1, 2, 3, or 4 conservative amino acid substitutions; wherein the VL region comprises amino acids 1-99 of SEQ ID NO:18 or a variant thereof comprising 1, 2, 3, or 4 conservative amino acid substitutions;

j. wherein the VH region comprises amino acids 1-127 of SEQ ID NO:19 or a variant thereof comprising 1, 2, 3, or 4 conservative amino acid substitutions; wherein the VL region comprises amino acids 1-99 of SEQ ID NO:20 or a variant thereof comprising 1, 2, 3, or 4 conservative amino acid substitutions;

k. wherein the VH region comprises amino acids 1-127 of SEQ ID NO:21 or a variant thereof comprising 1, 2, 3, or 4 conservative amino acid substitutions; wherein the VL region comprises amino acids 1-99 of SEQ ID NO:22 or a variant thereof comprising 1, 2, 3, or 4 conservative amino acid substitutions;

l. wherein the VH region comprises amino acids 1-127 of SEQ ID NO:23 or a variant thereof comprising 1, 2, 3, or 4 conservative amino acid substitutions; wherein the VL region comprises amino acids 1-99 of SEQ ID NO:24 or a variant thereof comprising 1, 2, 3, or 4 conservative amino acid substitutions;

m. wherein the VH region comprises amino acids 1-127 of SEQ ID NO:25 or a variant thereof comprising 1, 2, 3, or 4 conservative amino acid substitutions; wherein the VL region comprises amino acids 1-99 of SEQ ID NO:26 or a variant thereof comprising 1, 2, 3, or 4 conservative amino acid substitutions;
n. wherein the VH region comprises amino acids 1-127 of SEQ ID NO:27 or a variant thereof comprising 1, 2, 3, or 4 conservative amino acid substitutions; wherein the VL region comprises amino acids 1-99 of SEQ ID NO:28 or a variant thereof comprising 1, 2, 3, or 4 conservative amino acid substitutions;
o. wherein the VH region comprises amino acids 1-127 of SEQ ID NO:29 or a variant thereof comprising 1, 2, 3, or 4 conservative amino acid substitutions; wherein the VL region comprises amino acids 1-99 of SEQ ID NO:30 or a variant thereof comprising 1, 2, 3, or 4 conservative amino acid substitutions;
p. wherein the VH region comprises amino acids 1-127 of SEQ ID NO:31 or a variant thereof comprising 1, 2, 3, or 4 conservative amino acid substitutions; wherein the VL region comprises amino acids 1-99 of SEQ ID NO:32 or a variant thereof comprising 1, 2, 3, or 4 conservative amino acid substitutions;
q. wherein the VH region comprises amino acids 1-127 of SEQ ID NO:33 or a variant thereof comprising 1, 2, 3, or 4 conservative amino acid substitutions; wherein the VL region comprises amino acids 1-99 of SEQ ID NO:34 or a variant thereof comprising 1, 2, 3, or 4 conservative amino acid substitutions;
r. wherein the VH region comprises amino acids 1-120 of SEQ ID NO:35 or a variant thereof comprising 1, 2, 3, or 4 conservative amino acid substitutions; wherein the VL region comprises amino acids 1-100 of SEQ ID NO:36 or a variant thereof comprising 1, 2, 3, or 4 conservative amino acid substitutions;
s. wherein the VH region comprises amino acids 1-120 of SEQ ID NO:37 or a variant thereof comprising 1, 2, 3, or 4 conservative amino acid substitutions; wherein the VL region comprises amino acids 1-97 of SEQ ID NO:38 or a variant thereof comprising 1, 2, 3, or 4 conservative amino acid substitutions;
t. wherein the VH region comprises amino acids 1-123 of SEQ ID NO:39 or a variant thereof comprising 1, 2, 3, or 4 conservative amino acid substitutions; wherein the VL region comprises amino acids 1-100 of SEQ ID NO:40 or a variant thereof comprising 1, 2, 3, or 4 conservative amino acid substitutions;
u. wherein the VH region comprises amino acids 1-120 of SEQ ID NO:41 or a variant thereof comprising 1, 2, 3, or 4 conservative amino acid substitutions; wherein the VL region comprises amino acids 1-100 of SEQ ID NO:42 or a variant thereof comprising 1, 2, 3, or 4 conservative amino acid substitutions;
v. wherein the VH region comprises amino acids 1-120 of SEQ ID NO:43 or a variant thereof comprising 1, 2, 3, or 4 conservative amino acid substitutions; wherein the VL region comprises amino acids 1-97 of SEQ ID NO:44 or a variant thereof comprising 1, 2, 3, or 4 conservative amino acid substitutions;
w. wherein the VH region comprises amino acids 1-125 of SEQ ID NO:45 or a variant thereof comprising 1, 2, 3, or 4 conservative amino acid substitutions; wherein the VL region comprises amino acids 1-101 of SEQ ID NO:46 or a variant thereof comprising 1, 2, 3, or 4 conservative amino acid substitutions;
x. wherein the VH region comprises amino acids 1-125 of SEQ ID NO:47 or a variant thereof comprising 1, 2, 3, or 4 conservative amino acid substitutions; wherein the VL region comprises amino acids 1-101 of SEQ ID NO:48 or a variant thereof comprising 1, 2, 3, or 4 conservative amino acid substitutions;
y. wherein the VH region comprises amino acids 1-120 of SEQ ID NO:49 or a variant thereof comprising 1, 2, 3, or 4 conservative amino acid substitutions; wherein the VL region comprises amino acids 1-96 of SEQ ID NO:50 or a variant thereof comprising 1, 2, 3, or 4 conservative amino acid substitutions;
z. wherein the VH region comprises amino acids 1-120 of SEQ ID NO:51 or a variant thereof comprising 1, 2, 3, or 4 conservative amino acid substitutions; wherein the VL region comprises amino acids 1-97 of SEQ ID NO:52 or a variant thereof comprising 1, 2, 3, or 4 conservative amino acid substitutions;
aa. wherein the VH region comprises amino acids 1-121 of SEQ ID NO:53 or a variant thereof comprising 1, 2, 3, or 4 conservative amino acid substitutions; wherein the VL region comprises amino acids 1-99 of SEQ ID NO:54 or a variant thereof comprising 1, 2, 3, or 4 conservative amino acid substitutions;
bb. wherein the VH region comprises amino acids 1-121 of SEQ ID NO:55 or a variant thereof comprising 1, 2, 3, or 4 conservative amino acid substitutions; wherein the VL region comprises amino acids 1-99 of SEQ ID NO:56 or a variant thereof comprising 1, 2, 3, or 4 conservative amino acid substitutions;
cc. wherein the VH region comprises amino acids 1-121 of SEQ ID NO:57 or a variant thereof comprising 1, 2, 3, or 4 conservative amino acid substitutions; wherein the VL region comprises amino acids 1-99 of SEQ ID NO:58 or a variant thereof comprising 1, 2, 3, or 4 conservative amino acid substitutions;
dd. wherein the VH region comprises amino acids 1-121 of SEQ ID NO:59 or a variant thereof comprising 1, 2, 3, or 4 conservative amino acid substitutions; wherein the VL region comprises amino acids 1-99 of SEQ ID NO:60 or a variant thereof comprising 1, 2, 3, or 4 conservative amino acid substitutions;
ee. wherein the VH region comprises amino acids 1-120 of SEQ ID NO:61 or a variant thereof comprising 1, 2, 3, or 4 conservative amino acid substitutions; wherein the VL region comprises amino acids 1-98 of SEQ ID NO:62 or a variant thereof comprising 1, 2, 3, or 4 conservative amino acid substitutions;
ff. wherein the VH region comprises amino acids 1-121 of SEQ ID NO:63 or a variant thereof comprising 1, 2, 3, or 4 conservative amino acid substitutions; wherein the VL region comprises amino acids 1-99 of SEQ ID NO:64 or a variant thereof comprising 1, 2, 3, or 4 conservative amino acid substitutions;
gg. wherein the VH region comprises amino acids 1-121 of SEQ ID NO:65 or a variant thereof comprising 1, 2, 3, or 4 conservative amino acid substitutions; wherein the VL region comprises amino acids 1-99 of SEQ ID NO:66 or a variant thereof comprising 1, 2, 3, or 4 conservative amino acid substitutions;
hh. wherein the VH region comprises amino acids 1-120 of SEQ ID NO:67 or a variant thereof comprising 1, 2, 3, or 4 conservative amino acid substitutions; wherein the VL region comprises amino acids 1-96 of SEQ ID NO:68 or a variant thereof comprising 1, 2, 3, or 4 conservative amino acid substitutions;

ii. wherein the VH region comprises amino acids 1-120 of SEQ ID NO:69 or a variant thereof comprising 1, 2, 3, or 4 conservative amino acid substitutions; wherein the VL region comprises amino acids 1-96 of SEQ ID NO:70 or a variant thereof comprising 1, 2, 3, or 4 conservative amino acid substitutions;

jj. wherein the VH region comprises amino acids 1-120 of SEQ ID NO:71 or a variant thereof comprising 1, 2, 3, or 4 conservative amino acid substitutions; wherein the VL region comprises amino acids 1-96 of SEQ ID NO:72 or a variant thereof comprising 1, 2, 3, or 4 conservative amino acid substitutions;

kk. wherein the VH region comprises amino acids 1-125 of SEQ ID NO:73 or a variant thereof comprising 1, 2, 3, or 4 conservative amino acid substitutions; wherein the VL region comprises amino acids 1-101 of SEQ ID NO:74 or a variant thereof comprising 1, 2, 3, or 4 conservative amino acid substitutions;

ll. wherein the VH region comprises amino acids 1-120 of SEQ ID NO:75 or a variant thereof comprising 1, 2, 3, or 4 conservative amino acid substitutions; wherein the VL region comprises amino acids 1-97 of SEQ ID NO:76 or a variant thereof comprising 1, 2, 3, or 4 conservative amino acid substitutions;

mm. wherein the VH region comprises amino acids 1-128 of SEQ ID NO:153 or a variant thereof comprising 1, 2, 3, or 4 conservative amino acid substitutions; wherein the VL region comprises amino acids 1-99 of SEQ ID NO:155 or a variant thereof comprising 1, 2, 3, or 4 conservative amino acid substitutions;

nn. wherein the VH region comprises amino acids 1-128 of SEQ ID NO:157 or a variant thereof comprising 1, 2, 3, or 4 conservative amino acid substitutions; wherein the VL region comprises amino acids 1-99 of SEQ ID NO:159 or a variant thereof comprising 1, 2, 3, or 4 conservative amino acid substitutions;

oo. wherein the VH region comprises amino acids 1-127 of SEQ ID NO:161 or a variant thereof comprising 1, 2, 3, or 4 conservative amino acid substitutions; wherein the VL region comprises amino acids 1-99 of SEQ ID NO:163 or a variant thereof comprising 1, 2, 3, or 4 conservative amino acid substitutions;

pp. wherein the VH region comprises amino acids 1-127 of SEQ ID NO:165 or a variant thereof comprising 1, 2, 3, or 4 conservative amino acid substitutions; wherein the VL region comprises amino acids 1-99 of SEQ ID NO:167 or a variant thereof comprising 1, 2, 3, or 4 conservative amino acid substitutions;

qq. wherein the VH region comprises amino acids 1-127 of SEQ ID NO:169 or a variant thereof comprising 1, 2, 3, or 4 conservative amino acid substitutions; wherein the VL region comprises amino acids 1-99 of SEQ ID NO:171 or a variant thereof comprising 1, 2, 3, or 4 conservative amino acid substitutions;

rr. wherein the VH region comprises amino acids 1-127 of SEQ ID NO:173 or a variant thereof comprising 1, 2, 3, or 4 conservative amino acid substitutions; wherein the VL region comprises amino acids 1-99 of SEQ ID NO:175 or a variant thereof comprising 1, 2, 3, or 4 conservative amino acid substitutions;

ss. wherein the VH region comprises amino acids 1-127 of SEQ ID NO:177 or a variant thereof comprising 1, 2, 3, or 4 conservative amino acid substitutions; wherein the VL region comprises amino acids 1-99 of SEQ ID NO:179 or a variant thereof comprising 1, 2, 3, or 4 conservative amino acid substitutions;

tt. wherein the VH region comprises amino acids 1-127 of SEQ ID NO:181 or a variant thereof comprising 1, 2, 3, or 4 conservative amino acid substitutions; wherein the VL region comprises amino acids 1-99 of SEQ ID NO:183 or a variant thereof comprising 1, 2, 3, or 4 conservative amino acid substitutions;

uu. wherein the VH region comprises amino acids 1-127 of SEQ ID NO:185 or a variant thereof comprising 1, 2, 3, or 4 conservative amino acid substitutions; wherein the VL region comprises amino acids 1-99 of SEQ ID NO:187 or a variant thereof comprising 1, 2, 3, or 4 conservative amino acid substitutions;

vv. wherein the VH region comprises amino acids 1-127 of SEQ ID NO:189 or a variant thereof comprising 1, 2, 3, or 4 conservative amino acid substitutions; wherein the VL region comprises amino acids 1-99 of SEQ ID NO:191 or a variant thereof comprising 1, 2, 3, or 4 conservative amino acid substitutions;

ww. wherein the VH region comprises amino acids 1-127 of SEQ ID NO:193 or a variant thereof comprising 1, 2, 3, or 4 conservative amino acid substitutions; wherein the VL region comprises amino acids 1-99 of SEQ ID NO:195 or a variant thereof comprising 1, 2, 3, or 4 conservative amino acid substitutions;

xx. wherein the VH region comprises amino acids 1-127 of SEQ ID NO:197 or a variant thereof comprising 1, 2, 3, or 4 conservative amino acid substitutions; wherein the VL region comprises amino acids 1-99 of SEQ ID NO:199 or a variant thereof comprising 1, 2, 3, or 4 conservative amino acid substitutions;

yy. wherein the VH region comprises amino acids 1-127 of SEQ ID NO:201 or a variant thereof comprising 1, 2, 3, or 4 conservative amino acid substitutions; wherein the VL region comprises amino acids 1-99 of SEQ ID NO:203 or a variant thereof comprising 1, 2, 3, or 4 conservative amino acid substitutions;

zz. wherein the VH region comprises amino acids 1-127 of SEQ ID NO:205 or a variant thereof comprising 1, 2, 3, or 4 conservative amino acid substitutions; wherein the VL region comprises amino acids 1-99 of SEQ ID NO:207 or a variant thereof comprising 1, 2, 3, or 4 conservative amino acid substitutions;

aaa. wherein the VH region comprises amino acids 1-127 of SEQ ID NO:209 or a variant thereof comprising 1, 2, 3, or 4 conservative amino acid substitutions; wherein the VL region comprises amino acids 1-100 of SEQ ID NO:211 or a variant thereof comprising 1, 2, 3, or 4 conservative amino acid substitutions;

bbb. wherein the VH region comprises amino acids 1-127 of SEQ ID NO:213 or a variant thereof comprising 1, 2, 3, or 4 conservative amino acid substitutions; wherein the VL region comprises amino acids 1-99 of SEQ ID NO:215 or a variant thereof comprising 1, 2, 3, or 4 conservative amino acid substitutions; wherein the VH region comprises amino acids 1-127 of SEQ ID NO:217 or a variant thereof comprising 1, 2, 3, or 4 conservative amino acid substitutions; wherein the VL region comprises amino acids 1-99 of SEQ ID NO:219 or a variant thereof comprising 1, 2, 3, or 4 conservative amino acid substitutions;

ccc. wherein the VH region comprises amino acids 1-127 of SEQ ID NO:221 or a variant thereof comprising 1, 2, 3, or 4 conservative amino acid substitutions; wherein the VL region comprises amino acids 1-99 of SEQ ID NO:223 or a variant thereof comprising 1, 2, 3, or 4 conservative amino acid substitutions;

ddd. wherein the VH region comprises amino acids 1-128 of SEQ ID NO:225 or a variant thereof comprising 1, 2, 3, or 4 conservative amino acid substitutions; wherein the VL region comprises amino acids 1-99 of SEQ ID NO:227 or a variant thereof comprising 1, 2, 3, or 4 conservative amino acid substitutions;

eee. wherein the VH region comprises amino acids 1-127 of SEQ ID NO:229 or a variant thereof comprising 1, 2, 3, or 4 conservative amino acid substitutions; wherein the VL region comprises amino acids 1-99 of SEQ ID NO:231 or a variant thereof comprising 1, 2, 3, or 4 conservative amino acid substitutions;

fff. wherein the VH region comprises amino acids 1-127 of SEQ ID NO:233 or a variant thereof comprising 1, 2, 3, or 4 conservative amino acid substitutions; wherein the VL region comprises amino acids 1-99 of SEQ ID NO:235 or a variant thereof comprising 1, 2, 3, or 4 conservative amino acid substitutions;

ggg. wherein the VH region comprises amino acids 1-127 of SEQ ID NO:237 or a variant thereof comprising 1, 2, 3, or 4 conservative amino acid substitutions; wherein the VL region comprises amino acids 1-99 of SEQ ID NO:239 or a variant thereof comprising 1, 2, 3, or 4 conservative amino acid substitutions;

hhh. wherein the VH region comprises amino acids 1-127 of SEQ ID NO:241 or a variant thereof comprising 1, 2, 3, or 4 conservative amino acid substitutions; wherein the VL region comprises amino acids 1-99 of SEQ ID NO:243 or a variant thereof comprising 1, 2, 3, or 4 conservative amino acid substitutions;

iii. wherein the VH region comprises amino acids 1-127 of SEQ ID NO:245 or a variant thereof comprising 1, 2, 3, or 4 conservative amino acid substitutions; wherein the VL region comprises amino acids 1-99 of SEQ ID NO:247 or a variant thereof comprising 1, 2, 3, or 4 conservative amino acid substitutions;

jjj. wherein the VH region comprises amino acids 1-127 of SEQ ID NO:249 or a variant thereof comprising 1, 2, 3, or 4 conservative amino acid substitutions; wherein the VL region comprises amino acids 1-99 of SEQ ID NO:251 or a variant thereof comprising 1, 2, 3, or 4 conservative amino acid substitutions;

kkk wherein the VH region comprises amino acids 1-127 of SEQ ID NO:253 or a variant thereof comprising 1, 2, 3, or 4 conservative amino acid substitutions; wherein the VL region comprises amino acids 1-99 of SEQ ID NO:255 or a variant thereof comprising 1, 2, 3, or 4 conservative amino acid substitutions;

lll. wherein the VH region comprises amino acids 1-127 of SEQ ID NO:257 or a variant thereof comprising 1, 2, 3, or 4 conservative amino acid substitutions; wherein the VL region comprises amino acids 1-99 of SEQ ID NO:259 or a variant thereof comprising 1, 2, 3, or 4 conservative amino acid substitutions;

mmm. wherein the VH region comprises amino acids 1-127 of SEQ ID NO:261 or a variant thereof comprising 1, 2, 3, or 4 conservative amino acid substitutions; wherein the VL region comprises amino acids 1-99 of SEQ ID NO:263 or a variant thereof comprising 1, 2, 3, or 4 conservative amino acid substitutions;

nnn. wherein the VH region comprises amino acids 1-127 of SEQ ID NO:265 or a variant thereof comprising 1, 2, 3, or 4 conservative amino acid substitutions; wherein the VL region comprises amino acids 1-99 of SEQ ID NO:267 or a variant thereof comprising 1, 2, 3, or 4 conservative amino acid substitutions;

ooo. wherein the VH region comprises amino acids 1-127 of SEQ ID NO:269 or a variant thereof comprising 1, 2, 3, or 4 conservative amino acid substitutions; wherein the VL region comprises amino acids 1-99 of SEQ ID NO:271 or a variant thereof comprising 1, 2, 3, or 4 conservative amino acid substitutions;

ppp. wherein the VH region comprises amino acids 1-127 of SEQ ID NO:273 or a variant thereof comprising 1, 2, 3, or 4 conservative amino acid substitutions; wherein the VL region comprises amino acids 1-99 of SEQ ID NO:275 or a variant thereof comprising 1, 2, 3, or 4 conservative amino acid substitutions;

qqq. wherein the VH region comprises amino acids 1-127 of SEQ ID NO:277 or a variant thereof comprising 1, 2, 3, or 4 conservative amino acid substitutions; wherein the VL region comprises amino acids 1-99 of SEQ ID NO:279 or a variant thereof comprising 1, 2, 3, or 4 conservative amino acid substitutions;

rrr. wherein the VH region comprises amino acids 1-127 of SEQ ID NO:281 or a variant thereof comprising 1, 2, 3, or 4 conservative amino acid substitutions; wherein the VL region comprises amino acids 1-99 of SEQ ID NO:283 or a variant thereof comprising 1, 2, 3, or 4 conservative amino acid substitutions;

sss. wherein the VH region comprises amino acids 1-127 of SEQ ID NO:285 or a variant thereof comprising 1, 2, 3, or 4 conservative amino acid substitutions; wherein the VL region comprises amino acids 1-99 of SEQ ID NO:287 or a variant thereof comprising 1, 2, 3, or 4 conservative amino acid substitutions;

ttt. wherein the VH region comprises amino acids 1-127 of SEQ ID NO:289 or a variant thereof comprising 1, 2, 3, or 4 conservative amino acid substitutions; wherein the VL region comprises amino acids 1-99 of SEQ ID NO:291 or a variant thereof comprising 1, 2, 3, or 4 conservative amino acid substitutions;

uuu. wherein the VH region comprises amino acids 1-120 of SEQ ID NO:293 or a variant thereof comprising 1, 2, 3, or 4 conservative amino acid substitutions; wherein the VL region comprises amino acids 1-100 of SEQ ID NO:295 or a variant thereof comprising 1, 2, 3, or 4 conservative amino acid substitutions;

vvv. wherein the VH region comprises amino acids 1-120 of SEQ ID NO:297 or a variant thereof comprising 1, 2, 3, or 4 conservative amino acid substitutions; wherein the VL region comprises amino acids 1-100 of SEQ ID NO:299 or a variant thereof comprising 1, 2, 3, or 4 conservative amino acid substitutions;

www. wherein the VH region comprises amino acids 1-120 of SEQ ID NO:301 or a variant thereof comprising 1, 2, 3, or 4 conservative amino acid substitutions; wherein the VL region comprises amino acids 1-100 of SEQ ID NO:303 or a variant thereof comprising 1, 2, 3, or 4 conservative amino acid substitutions;

xxx. wherein the VH region comprises amino acids 1-123 of SEQ ID NO:305 or a variant thereof comprising 1, 2, 3, or 4 conservative amino acid substitutions; wherein the VL region comprises amino acids 1-100 of SEQ ID NO:307 or a variant thereof comprising 1, 2, 3, or 4 conservative amino acid substitutions;

yyy. wherein the VH region comprises amino acids 1-128 of SEQ ID NO:309 or a variant thereof comprising 1, 2, 3, or 4 conservative amino acid substitutions; wherein the VL region comprises amino acids 1-100 of SEQ ID NO:311 or a variant thereof comprising 1, 2, 3, or 4 conservative amino acid substitutions;

zzz. wherein the VH region comprises amino acids 1-128 of SEQ ID NO:313 or a variant thereof comprising 1, 2, 3, or 4 conservative amino acid substitutions; wherein the VL region comprises amino acids 1-100 of SEQ ID NO:315 or a variant thereof comprising 1, 2, 3, or 4 conservative amino acid substitutions;

aaaa. wherein the VH region comprises amino acids 1-120 of SEQ ID NO:317 or a variant thereof comprising 1, 2, 3, or 4 conservative amino acid substitutions; wherein the VL region comprises amino acids 1-97 of SEQ ID NO:319 or a variant thereof comprising 1, 2, 3, or 4 conservative amino acid substitutions;

bbbb. wherein the VH region comprises amino acids 1-123 of SEQ ID NO:321 or a variant thereof comprising 1, 2, 3, or 4 conservative amino acid substitutions; wherein the VL region comprises amino acids 1-100 of SEQ ID NO:323 or a variant thereof comprising 1, 2, 3, or 4 conservative amino acid substitutions;

cccc. wherein the VH region comprises amino acids 1-120 of SEQ ID NO:325 or a variant thereof comprising 1, 2, 3, or 4 conservative amino acid substitutions; wherein the VL region comprises amino acids 1-100 of SEQ ID NO:327 or a variant thereof comprising 1, 2, 3, or 4 conservative amino acid substitutions;

dddd. wherein the VH region comprises amino acids 1-120 of SEQ ID NO:329 or a variant thereof comprising 1, 2, 3, or 4 conservative amino acid substitutions; wherein the VL region comprises amino acids 1-100 of SEQ ID NO:331 or a variant thereof comprising 1, 2, 3, or 4 conservative amino acid substitutions;

eeee. wherein the VH region comprises amino acids 1-120 of SEQ ID NO:333 or a variant thereof comprising 1, 2, 3, or 4 conservative amino acid substitutions; wherein the VL region comprises amino acids 1-97 of SEQ ID NO:335 or a variant thereof comprising 1, 2, 3, or 4 conservative amino acid substitutions;

ffff. wherein the VH region comprises amino acids 1-125 of SEQ ID NO:337 or a variant thereof comprising 1, 2, 3, or 4 conservative amino acid substitutions; wherein the VL region comprises amino acids 1-101 of SEQ ID NO:339 or a variant thereof comprising 1, 2, 3, or 4 conservative amino acid substitutions;

gggg. wherein the VH region comprises amino acids 1-125 of SEQ ID NO:341 or a variant thereof comprising 1, 2, 3, or 4 conservative amino acid substitutions; wherein the VL region comprises amino acids 1-101 of SEQ ID NO:343 or a variant thereof comprising 1, 2, 3, or 4 conservative amino acid substitutions;

hhhh. wherein the VH region comprises amino acids 1-120 of SEQ ID NO:345 or a variant thereof comprising 1, 2, 3, or 4 conservative amino acid substitutions; wherein the VL region comprises amino acids 1-96 of SEQ ID NO:347 or a variant thereof comprising 1, 2, 3, or 4 conservative amino acid substitutions;

iiii. wherein the VH region comprises amino acids 1-120 of SEQ ID NO:349 or a variant thereof comprising 1, 2, 3, or 4 conservative amino acid substitutions; wherein the VL region comprises amino acids 1-97 of SEQ ID NO:351 or a variant thereof comprising 1, 2, 3, or 4 conservative amino acid substitutions;

jjjj. wherein the VH region comprises amino acids 1-121 of SEQ ID NO:353 or a variant thereof comprising 1, 2, 3, or 4 conservative amino acid substitutions; wherein the VL region comprises amino acids 1-99 of SEQ ID NO:355 or a variant thereof comprising 1, 2, 3, or 4 conservative amino acid substitutions;

kkkk wherein the VH region comprises amino acids 1-121 of SEQ ID NO:357 or a variant thereof comprising 1, 2, 3, or 4 conservative amino acid substitutions; wherein the VL region comprises amino acids 1-99 of SEQ ID NO:359 or a variant thereof comprising 1, 2, 3, or 4 conservative amino acid substitutions;

llll. wherein the VH region comprises amino acids 1-121 of SEQ ID NO:361 or a variant thereof comprising 1, 2, 3, or 4 conservative amino acid substitutions; wherein the VL region comprises amino acids 1-99 of SEQ ID NO:363 or a variant thereof comprising 1, 2, 3, or 4 conservative amino acid substitutions;

mmmm. wherein the VH region comprises amino acids 1-121 of SEQ ID NO:365 or a variant thereof comprising 1, 2, 3, or 4 conservative amino acid substitutions; wherein the VL region comprises amino acids 1-99 of SEQ ID NO:367 or a variant thereof comprising 1, 2, 3, or 4 conservative amino acid substitutions;

nnnn. wherein the VH region comprises amino acids 1-120 of SEQ ID NO:369 or a variant thereof comprising 1, 2, 3, or 4 conservative amino acid substitutions; wherein the VL region comprises amino acids 1-98 of SEQ ID NO:371 or a variant thereof comprising 1, 2, 3, or 4 conservative amino acid substitutions;

oooo. wherein the VH region comprises amino acids 1-121 of SEQ ID NO:373 or a variant thereof comprising 1, 2, 3, or 4 conservative amino acid substitutions; wherein the VL region comprises amino acids 1-99 of SEQ ID NO:375 or a variant thereof comprising 1, 2, 3, or 4 conservative amino acid substitutions;

pppp. wherein the VH region comprises amino acids 1-121 of SEQ ID NO:377 or a variant thereof comprising 1, 2, 3, or 4 conservative amino acid substitutions; wherein the VL region comprises amino acids 1-99 of SEQ ID NO:379 or a variant thereof comprising 1, 2, 3, or 4 conservative amino acid substitutions;

qqqq. wherein the VH region comprises amino acids 1-120 of SEQ ID NO:381 or a variant thereof comprising 1, 2, 3, or 4 conservative amino acid substitutions; wherein the VL region comprises amino acids 1-96 of SEQ ID NO:383 or a variant thereof comprising 1, 2, 3, or 4 conservative amino acid substitutions;

rrrr. wherein the VH region comprises amino acids 1-120 of SEQ ID NO:385 or a variant thereof comprising 1, 2, 3, or 4 conservative amino acid substitutions; wherein the VL region comprises amino acids 1-96 of SEQ ID NO:387 or a variant thereof comprising 1, 2, 3, or 4 conservative amino acid substitutions;

ssss. wherein the VH region comprises amino acids 1-120 of SEQ ID NO:389 or a variant thereof comprising 1, 2, 3, or 4 conservative amino acid substitutions; wherein the VL region comprises amino acids 1-96 of SEQ ID NO:391 or a variant thereof comprising 1, 2, 3, or 4 conservative amino acid substitutions;

tttt. wherein the VH region comprises amino acids 1-125 of SEQ ID NO:393 or a variant thereof comprising 1, 2, 3, or 4 conservative amino acid substitutions; wherein the VL region comprises amino acids 1-101 of SEQ ID NO:395 or a variant thereof comprising 1, 2, 3, or 4 conservative amino acid substitutions;

uuuu. wherein the VH region comprises and amino acids 1-120 of SEQ ID NO:397 or a variant thereof comprising 1, 2, 3, or 4 conservative amino acid substitutions; and wherein the VL region comprises amino acids 1-97 of SEQ ID NO:399 or a variant thereof comprising 1, 2, 3, or 4 conservative amino acid substitutions.

61. The anti-HIV antibody of any of paragraphs 1-60, wherein the anti-HIV antibody is selected from the group consisting of:
a. an antibody comprising a heavy chain amino acid sequence comprising SEQ ID NO:1 or an antigen binding fragment thereof and a light chain amino acid sequence comprising SEQ ID NO:2 or an antigen binding fragment thereof;
b. an antibody comprising a heavy chain amino acid sequence comprising SEQ ID NO:3 or an antigen binding fragment thereof and a light chain amino acid sequence comprising SEQ ID NO:4 or an antigen binding fragment thereof;
c. an antibody comprising a heavy chain amino acid sequence comprising SEQ ID NO:5 or an antigen binding fragment thereof and a light chain amino acid sequence comprising SEQ ID NO:6 or an antigen binding fragment thereof;
d. an antibody comprising a heavy chain amino acid sequence comprising SEQ ID NO:7 or an antigen binding fragment thereof and a light chain amino acid sequence comprising SEQ ID NO:8 or an antigen binding fragment thereof;
e. an antibody comprising a heavy chain amino acid sequence comprising SEQ ID NO:9 or an antigen binding fragment thereof and a light chain amino acid sequence comprising SEQ ID NO:10 or an antigen binding fragment thereof;
f. an antibody comprising a heavy chain amino acid sequence comprising SEQ ID NO:11 or an antigen binding fragment thereof and a light chain amino acid sequence comprising SEQ ID NO:12 or an antigen binding fragment thereof;
g. an antibody comprising a heavy chain amino acid sequence comprising SEQ ID NO:13 or an antigen binding fragment thereof and a light chain amino acid sequence comprising SEQ ID NO:14 or an antigen binding fragment thereof;
h. an antibody comprising a heavy chain amino acid sequence comprising SEQ ID NO:15 or an antigen binding fragment thereof and a light chain amino acid sequence comprising SEQ ID NO:16 or an antigen binding fragment thereof;
i. an antibody comprising a heavy chain amino acid sequence comprising SEQ ID NO:17 or an antigen binding fragment thereof and a light chain amino acid sequence comprising SEQ ID NO:18 or an antigen binding fragment thereof;
j. an antibody comprising a heavy chain amino acid sequence comprising SEQ ID NO:19 or an antigen binding fragment thereof and a light chain amino acid sequence comprising SEQ ID NO:20 or an antigen binding fragment thereof;
k. an antibody comprising a heavy chain amino acid sequence comprising SEQ ID NO:21 or an antigen binding fragment thereof and a light chain amino acid sequence comprising SEQ ID NO:22 or an antigen binding fragment thereof;
l. an antibody comprising a heavy chain amino acid sequence comprising SEQ ID NO:23 or an antigen binding fragment thereof and a light chain amino acid sequence comprising SEQ ID NO:24 or an antigen binding fragment thereof;
m. an antibody comprising a heavy chain amino acid sequence comprising SEQ ID NO:25 or an antigen binding fragment thereof and a light chain amino acid sequence comprising SEQ ID NO:26 or an antigen binding fragment thereof;
n. an antibody comprising a heavy chain amino acid sequence comprising SEQ ID NO:27 or an antigen binding fragment thereof and a light chain amino acid sequence comprising SEQ ID NO:28 or an antigen binding fragment thereof;
o. an antibody comprising a heavy chain amino acid sequence comprising SEQ ID NO:29 or an antigen binding fragment thereof and a light chain amino acid sequence comprising SEQ ID NO:30 or an antigen binding fragment thereof;
p. an antibody comprising a heavy chain amino acid sequence comprising SEQ ID NO:31 or an antigen binding fragment thereof and a light chain amino acid sequence comprising SEQ ID NO:32 or an antigen binding fragment thereof;
q. an antibody comprising a heavy chain amino acid sequence comprising SEQ ID NO:33 or an antigen binding fragment thereof and a light chain amino acid sequence comprising SEQ ID NO:34 or an antigen binding fragment thereof;
r. an antibody comprising a heavy chain amino acid sequence comprising SEQ ID NO:35 or an antigen binding fragment thereof and a light chain amino acid sequence comprising SEQ ID NO:36 or an antigen binding fragment thereof;
s. an antibody comprising a heavy chain amino acid sequence comprising SEQ ID NO:37 or an antigen binding fragment thereof and a light chain amino acid sequence comprising SEQ ID NO:38 or an antigen binding fragment thereof;
t. an antibody comprising a heavy chain amino acid sequence comprising SEQ ID NO:39 or an antigen binding fragment thereof and a light chain amino acid sequence comprising SEQ ID NO:40 or an antigen binding fragment thereof;
u. an antibody comprising a heavy chain amino acid sequence comprising SEQ ID NO:41 or an antigen binding fragment thereof and a light chain amino acid sequence comprising SEQ ID NO:42 or an antigen binding fragment thereof;
v. an antibody comprising a heavy chain amino acid sequence comprising SEQ ID NO:43 or an antigen binding fragment thereof and a light chain amino acid sequence comprising SEQ ID NO:44 or an antigen binding fragment thereof;
w. an antibody comprising a heavy chain amino acid sequence comprising SEQ ID NO:45 or an antigen binding fragment thereof and a light chain amino acid sequence comprising SEQ ID NO:46 or an antigen binding fragment thereof;
x. an antibody comprising a heavy chain amino acid sequence comprising SEQ ID NO:47 or an antigen binding fragment thereof and a light chain amino acid sequence comprising SEQ ID NO:48 or an antigen binding fragment thereof;
y. an antibody comprising a heavy chain amino acid sequence comprising SEQ ID NO:49 or an antigen binding fragment thereof and a light chain amino acid sequence comprising SEQ ID NO:50 or an antigen binding fragment thereof;
z. an antibody comprising a heavy chain amino acid sequence comprising SEQ ID NO:51 or an antigen binding fragment thereof and a light chain amino acid sequence comprising SEQ ID NO:52 or an antigen binding fragment thereof;
aa. an antibody comprising a heavy chain amino acid sequence comprising SEQ ID NO:53 or an antigen binding fragment thereof and a light chain amino acid sequence comprising SEQ ID NO:54 or an antigen binding fragment thereof;
bb. an antibody comprising a heavy chain amino acid sequence comprising SEQ ID NO:55 or an antigen binding fragment thereof and a light chain amino acid sequence comprising SEQ ID NO:56 or an antigen binding fragment thereof;
cc. an antibody comprising a heavy chain amino acid sequence comprising SEQ ID NO:57 or an antigen binding fragment thereof and a light chain amino acid sequence comprising SEQ ID NO:58 or an antigen binding fragment thereof;
dd. an antibody comprising a heavy chain amino acid sequence comprising SEQ ID NO:59 or an antigen binding fragment thereof and a light chain amino acid sequence comprising SEQ ID NO:60 or an antigen binding fragment thereof;
ee. an antibody comprising a heavy chain amino acid sequence comprising SEQ ID NO:61 or an antigen binding fragment thereof and a light chain amino acid sequence comprising SEQ ID NO:62 or an antigen binding fragment thereof;
ff. an antibody comprising a heavy chain amino acid sequence comprising SEQ ID NO:63 or an antigen binding fragment thereof and a light chain amino acid sequence comprising SEQ ID NO:64 or an antigen binding fragment thereof;
gg. an antibody comprising a heavy chain amino acid sequence comprising SEQ ID NO:65 or an antigen binding fragment thereof and a light chain amino acid sequence comprising SEQ ID NO:66 or an antigen binding fragment thereof;
hh. an antibody comprising a heavy chain amino acid sequence comprising SEQ ID NO:67 or an antigen binding fragment thereof and a light chain amino acid sequence comprising SEQ ID NO:68 or an antigen binding fragment thereof;
ii. an antibody comprising a heavy chain amino acid sequence comprising SEQ ID NO:69 or an antigen binding fragment thereof and a light chain amino acid sequence comprising SEQ ID NO:70 or an antigen binding fragment thereof;
jj. an antibody comprising a heavy chain amino acid sequence comprising SEQ ID NO:71 or an antigen binding fragment thereof and a light chain amino acid sequence comprising SEQ ID NO:72 or an antigen binding fragment thereof;
kk. an antibody comprising a heavy chain amino acid sequence comprising SEQ ID NO:73 or an antigen binding fragment thereof and a light chain amino acid sequence comprising SEQ ID NO:74 or an antigen binding fragment thereof;
ll. an antibody comprising a heavy chain amino acid sequence comprising SEQ ID NO:75 or an antigen binding fragment thereof and a light chain amino acid sequence comprising SEQ ID NO:76 or an antigen binding fragment thereof;
mm. an antibody comprising a heavy chain amino acid sequence comprising SEQ ID NO:153 or an antigen binding fragment thereof and a light chain amino acid sequence comprising SEQ ID NO:155 or an antigen binding fragment thereof;
nn. an antibody comprising a heavy chain amino acid sequence comprising SEQ ID NO:157 or an antigen binding fragment thereof and a light chain amino acid sequence comprising SEQ ID NO:159 or an antigen binding fragment thereof;
oo. an antibody comprising a heavy chain amino acid sequence comprising SEQ ID NO:161 or an antigen binding fragment thereof and a light chain amino acid sequence comprising SEQ ID NO:163 or an antigen binding fragment thereof;

pp. an antibody comprising a heavy chain amino acid sequence comprising SEQ ID NO:165 or an antigen binding fragment thereof and a light chain amino acid sequence comprising SEQ ID NO:167 or an antigen binding fragment thereof;
qq. an antibody comprising a heavy chain amino acid sequence comprising SEQ ID NO:169 or an antigen binding fragment thereof and a light chain amino acid sequence comprising SEQ ID NO:171 or an antigen binding fragment thereof;
rr. an antibody comprising a heavy chain amino acid sequence comprising SEQ ID NO:173 or an antigen binding fragment thereof and a light chain amino acid sequence comprising SEQ ID NO:175 or an antigen binding fragment thereof;
ss. an antibody comprising a heavy chain amino acid sequence comprising SEQ ID NO:177 or an antigen binding fragment thereof and a light chain amino acid sequence comprising SEQ ID NO:179 or an antigen binding fragment thereof;
tt. an antibody comprising a heavy chain amino acid sequence comprising SEQ ID NO:181 or an antigen binding fragment thereof and a light chain amino acid sequence comprising SEQ ID NO:183 or an antigen binding fragment thereof;
uu. an antibody comprising a heavy chain amino acid sequence comprising SEQ ID NO:185 or an antigen binding fragment thereof and a light chain amino acid sequence comprising SEQ ID NO:187 or an antigen binding fragment thereof;
vv. an antibody comprising a heavy chain amino acid sequence comprising SEQ ID NO:189 or an antigen binding fragment thereof and a light chain amino acid sequence comprising SEQ ID NO:191 or an antigen binding fragment thereof;
ww. an antibody comprising a heavy chain amino acid sequence comprising SEQ ID NO:193 or an antigen binding fragment thereof and a light chain amino acid sequence comprising SEQ ID NO:195 or an antigen binding fragment thereof;
xx. an antibody comprising a heavy chain amino acid sequence comprising SEQ ID NO:197 or an antigen binding fragment thereof and a light chain amino acid sequence comprising SEQ ID NO:199 or an antigen binding fragment thereof;
yy. an antibody comprising a heavy chain amino acid sequence comprising SEQ ID NO:201 or an antigen binding fragment thereof and a light chain amino acid sequence comprising SEQ ID NO:203 or an antigen binding fragment thereof;
zz. an antibody comprising a heavy chain amino acid sequence comprising SEQ ID NO:205 or an antigen binding fragment thereof and a light chain amino acid sequence comprising SEQ ID NO:207 or an antigen binding fragment thereof;
aaa. an antibody comprising a heavy chain amino acid sequence comprising SEQ ID NO:209 or an antigen binding fragment thereof and a light chain amino acid sequence comprising SEQ ID NO:211 or an antigen binding fragment thereof;
bbb. an antibody comprising a heavy chain amino acid sequence comprising SEQ ID NO:213 or an antigen binding fragment thereof and a light chain amino acid sequence comprising SEQ ID NO:215 or an antigen binding fragment thereof;
ccc. an antibody comprising a heavy chain amino acid sequence comprising SEQ ID NO:217 or an antigen binding fragment thereof and a light chain amino acid sequence comprising SEQ ID NO:219 or an antigen binding fragment thereof;
ddd. an antibody comprising a heavy chain amino acid sequence comprising SEQ ID NO:221 or an antigen binding fragment thereof and a light chain amino acid sequence comprising SEQ ID NO:223 or an antigen binding fragment thereof;
eee. an antibody comprising a heavy chain amino acid sequence comprising SEQ ID NO:225 or an antigen binding fragment thereof and a light chain amino acid sequence comprising SEQ ID NO:227 or an antigen binding fragment thereof;
fff. an antibody comprising a heavy chain amino acid sequence comprising SEQ ID NO:229 or an antigen binding fragment thereof and a light chain amino acid sequence comprising SEQ ID NO:231 or an antigen binding fragment thereof;
ggg. an antibody comprising a heavy chain amino acid sequence comprising SEQ ID NO:233 or an antigen binding fragment thereof and a light chain amino acid sequence comprising SEQ ID NO:235 or an antigen binding fragment thereof;
hhh. an antibody comprising a heavy chain amino acid sequence comprising SEQ ID NO:237 or an antigen binding fragment thereof and a light chain amino acid sequence comprising SEQ ID NO:239 or an antigen binding fragment thereof;
iii. an antibody comprising a heavy chain amino acid sequence comprising SEQ ID NO:241 or an antigen binding fragment thereof and a light chain amino acid sequence comprising SEQ ID NO:243 or an antigen binding fragment thereof;
jjj. an antibody comprising a heavy chain amino acid sequence comprising SEQ ID NO:245 or an antigen binding fragment thereof and a light chain amino acid sequence comprising SEQ ID NO:247 or an antigen binding fragment thereof;
kkk an antibody comprising a heavy chain amino acid sequence comprising SEQ ID NO:249 or an antigen binding fragment thereof and a light chain amino acid sequence comprising SEQ ID NO:251 or an antigen binding fragment thereof;
lll. an antibody comprising a heavy chain amino acid sequence comprising SEQ ID NO:253 or an antigen binding fragment thereof and a light chain amino acid sequence comprising SEQ ID NO:255 or an antigen binding fragment thereof;
mmm. an antibody comprising a heavy chain amino acid sequence comprising SEQ ID NO:257 or an antigen binding fragment thereof and a light chain amino acid sequence comprising SEQ ID NO:259 or an antigen binding fragment thereof;
nnn. an antibody comprising a heavy chain amino acid sequence comprising SEQ ID NO:261 or an antigen binding fragment thereof and a light chain amino acid sequence comprising SEQ ID NO:263 or an antigen binding fragment thereof;
ooo. an antibody comprising a heavy chain amino acid sequence comprising SEQ ID NO:265 or an antigen binding fragment thereof and a light chain amino acid sequence comprising SEQ ID NO:267 or an antigen binding fragment thereof;
ppp. an antibody comprising a heavy chain amino acid sequence comprising SEQ ID NO:269 or an antigen binding fragment thereof and a light chain amino acid sequence comprising SEQ ID NO:271 or an antigen binding fragment thereof;

qqq. an antibody comprising a heavy chain amino acid sequence comprising SEQ ID NO:273 or an antigen binding fragment thereof and a light chain amino acid sequence comprising SEQ ID NO:275 or an antigen binding fragment thereof;

rrr. an antibody comprising a heavy chain amino acid sequence comprising SEQ ID NO:277 or an antigen binding fragment thereof and a light chain amino acid sequence comprising SEQ ID NO:279 or an antigen binding fragment thereof;

sss. an antibody comprising a heavy chain amino acid sequence comprising SEQ ID NO:281 or an antigen binding fragment thereof and a light chain amino acid sequence comprising SEQ ID NO:283 or an antigen binding fragment thereof;

ttt. an antibody comprising a heavy chain amino acid sequence comprising SEQ ID NO:285 or an antigen binding fragment thereof and a light chain amino acid sequence comprising SEQ ID NO:287 or an antigen binding fragment thereof;

uuu. an antibody comprising a heavy chain amino acid sequence comprising SEQ ID NO:289 or an antigen binding fragment thereof and a light chain amino acid sequence comprising SEQ ID NO:291 or an antigen binding fragment thereof;

vvv. an antibody comprising a heavy chain amino acid sequence comprising SEQ ID NO:293 or an antigen binding fragment thereof and a light chain amino acid sequence comprising SEQ ID NO:295 or an antigen binding fragment thereof;

www. an antibody comprising a heavy chain amino acid sequence comprising SEQ ID NO:297 or an antigen binding fragment thereof and a light chain amino acid sequence comprising SEQ ID NO:299 or an antigen binding fragment thereof;

xxx. an antibody comprising a heavy chain amino acid sequence comprising SEQ ID NO:301 or an antigen binding fragment thereof and a light chain amino acid sequence comprising SEQ ID NO:303 or an antigen binding fragment thereof;

yyy. an antibody comprising a heavy chain amino acid sequence comprising SEQ ID NO:305 or an antigen binding fragment thereof and a light chain amino acid sequence comprising SEQ ID NO:307 or an antigen binding fragment thereof;

zzz. an antibody comprising a heavy chain amino acid sequence comprising SEQ ID NO:309 or an antigen binding fragment thereof and a light chain amino acid sequence comprising SEQ ID NO:311 or an antigen binding fragment thereof;

aaaa. an antibody comprising a heavy chain amino acid sequence comprising SEQ ID NO:313 or an antigen binding fragment thereof and a light chain amino acid sequence comprising SEQ ID NO:315 or an antigen binding fragment thereof;

bbbb. an antibody comprising a heavy chain amino acid sequence comprising SEQ ID NO:317 or an antigen binding fragment thereof and a light chain amino acid sequence comprising SEQ ID NO:319 or an antigen binding fragment thereof;

cccc. an antibody comprising a heavy chain amino acid sequence comprising SEQ ID NO:321 or an antigen binding fragment thereof and a light chain amino acid sequence comprising SEQ ID NO:323 or an antigen binding fragment thereof;

dddd. an antibody comprising a heavy chain amino acid sequence comprising SEQ ID NO:325 or an antigen binding fragment thereof and a light chain amino acid sequence comprising SEQ ID NO:327 or an antigen binding fragment thereof;

eeee. an antibody comprising a heavy chain amino acid sequence comprising SEQ ID NO:329 or an antigen binding fragment thereof and a light chain amino acid sequence comprising SEQ ID NO:331 or an antigen binding fragment thereof;

ffff. an antibody comprising a heavy chain amino acid sequence comprising SEQ ID NO:333 or an antigen binding fragment thereof and a light chain amino acid sequence comprising SEQ ID NO:335 or an antigen binding fragment thereof;

gggg. an antibody comprising a heavy chain amino acid sequence comprising SEQ ID NO:337 or an antigen binding fragment thereof and a light chain amino acid sequence comprising SEQ ID NO:339 or an antigen binding fragment thereof;

hhhh. an antibody comprising a heavy chain amino acid sequence comprising SEQ ID NO:341 or an antigen binding fragment thereof and a light chain amino acid sequence comprising SEQ ID NO:343 or an antigen binding fragment thereof;

iiii. an antibody comprising a heavy chain amino acid sequence comprising SEQ ID NO:345 or an antigen binding fragment thereof and a light chain amino acid sequence comprising SEQ ID NO:347 or an antigen binding fragment thereof;

jjjj. an antibody comprising a heavy chain amino acid sequence comprising SEQ ID NO:349 or an antigen binding fragment thereof and a light chain amino acid sequence comprising SEQ ID NO:351 or an antigen binding fragment thereof;

kkkk. an antibody comprising a heavy chain amino acid sequence comprising SEQ ID NO:353 or an antigen binding fragment thereof and a light chain amino acid sequence comprising SEQ ID NO:355 or an antigen binding fragment thereof;

llll. an antibody comprising a heavy chain amino acid sequence comprising SEQ ID NO:357 or an antigen binding fragment thereof and a light chain amino acid sequence comprising SEQ ID NO:359 or an antigen binding fragment thereof;

mmmm. an antibody comprising a heavy chain amino acid sequence comprising SEQ ID NO:361 or an antigen binding fragment thereof and a light chain amino acid sequence comprising SEQ ID NO:363 or an antigen binding fragment thereof;

nnnn. an antibody comprising a heavy chain amino acid sequence comprising SEQ ID NO:365 or an antigen binding fragment thereof and a light chain amino acid sequence comprising SEQ ID NO:367 or an antigen binding fragment thereof;

oooo. an antibody comprising a heavy chain amino acid sequence comprising SEQ ID NO:369 or an antigen binding fragment thereof and a light chain amino acid sequence comprising SEQ ID NO:371 or an antigen binding fragment thereof;

pppp. an antibody comprising a heavy chain amino acid sequence comprising SEQ ID NO:373 or an antigen binding fragment thereof and a light chain amino acid sequence comprising SEQ ID NO:375 or an antigen binding fragment thereof;

qqqq. an antibody comprising a heavy chain amino acid sequence comprising SEQ ID NO:377 or an antigen binding fragment thereof and a light chain amino acid sequence comprising SEQ ID NO:379 or an antigen binding fragment thereof;

rrrr. an antibody comprising a heavy chain amino acid sequence comprising SEQ ID NO:381 or an antigen binding fragment thereof and a light chain amino acid sequence comprising SEQ ID NO:383 or an antigen binding fragment thereof;

ssss. an antibody comprising a heavy chain amino acid sequence comprising SEQ ID NO:385 or an antigen binding fragment thereof and a light chain amino acid sequence comprising SEQ ID NO:387 or an antigen binding fragment thereof;

tttt. an antibody comprising a heavy chain amino acid sequence comprising SEQ ID NO:389 or an antigen binding fragment thereof and a light chain amino acid sequence comprising SEQ ID NO:391 or an antigen binding fragment thereof;

uuuu. an antibody comprising a heavy chain amino acid sequence comprising SEQ ID NO:393 or an antigen binding fragment thereof and a light chain amino acid sequence comprising SEQ ID NO:395 or an antigen binding fragment thereof; and vvvv. an antibody comprising a heavy chain amino acid sequence comprising SEQ ID NO:397 or an antigen binding fragment thereof and a light chain amino acid sequence comprising SEQ ID NO:399 or an antigen binding fragment thereof.

62. An isolated host cell expressing the antibody of any of paragraphs 1-61.

63. One or more vectors comprising a nucleic acid encoding the antibody of any of paragraphs 1-62.

64. The one or more vectors of paragraph 63, wherein one vector encodes a light chain sequence and another vector encodes a heavy chain sequence.

65. The one or more vectors of paragraph 64, wherein one vector encodes a light chain sequence and a heavy chain sequence.

66. A cell comprising the one or more vectors of any of paragraphs 62-65.

67. An engineered cell that expresses the antibody of any of paragraphs 1-66.

68. The cell of paragraph 67, wherein the cell is an immune cell.

69. The cell of paragraph 68, wherein the immune cell is a B cell.

70. A pharmaceutical composition comprising one or more antibodies of any of paragraphs 1-61 and/or cells of any of paragraphs 66-69 and a pharmaceutically acceptable carrier.

71. A method for treating or preventing HIV infection in a subject, comprising administering to the subject an effective amount of the composition of paragraph 70.

72. A method of functionally curing HIV comprising administering to the subject an effective amount of the composition of paragraph 70.

73. The method of any of paragraphs 71-72, wherein the composition is administered in combination with another therapy.

74. The method of paragraph 73, wherein the therapy is an anti-retroviral therapy.

Application of the teachings of the present invention to a specific problem is within the capabilities of one having ordinary skill in the art in light of the teaching contained herein. Examples of the compositions and methods of the invention appear in the following non-limiting Examples.

EXAMPLES

Example 1. Deconvoluting an HIV Super-Neutralizing Plasma Response

Anti-HIV-I envelope monoclonal antibodies isolated from memory B-cells have yielded broadly neutralizing antibodies (bNAbs), though none were pan-neutralizing. Here we identify a pan-neutralizing antibody lineage against a novel epitope by coupling proteomics of plasma antibodies with lineage analysis of bone marrow plasma cells from two HIV-1 "elite neutralizers." In both, a single lineage of anti-CD4 binding site antibodies matched circulating bNAbs sequences. Members of a single plasma cell lineage potently neutralized 100% of a validated multi-tier 117 pseudovirus panel, matching the sequence, specificity, and neutralization breadth of the circulating bNAbs. X-ray crystallography analysis of pan-neutralizing monoclonal, N49P7, identified its unique ability to bypass the CD4-binding site Phe43 cavity while reaching deep into the highly conserved residues of Layer 3 of the gp120 inner domain, likely accounting for its pan-neutralization. Conjoint analysis of plasma antibodies by proteomics and bone marrow derived lineages will improve understanding the evolution of anti-HIV-I bNAb responses.

Here we employed a matched genomic and proteomic approach to deconvolute a very broadly neutralizing response directed against gp120. The primary test subject, N60 (referred to as Subject 1 in a previous publication (Sajadi et al., *J Virol* 86, 5014-5025 (2012)) belongs to a previously reported Natural Viral Suppressor (NVS) cohort of subtype B-infected patients who exhibit persistent titers of very broad and potent neutralizing antibodies (Sajadi et al., *J Infect Dis* 213, 156-164 (2016); Sajadi et al., *J Virol* 86, 5014-5025 (2012).

We have previously found that multiple HIV-infected subjects harbor broad and potent neutralizing activities with highly shared biochemical determinants, such as basic isoelectric points (pI) and specificities for binding epitopes on free monomeric gp120 (Sajadi et al., *J Acquir Immune Defic Syndr* 57, 9-15 (2011); Sajadi et al., *J Infect Dis* 213, 156-164 (2016); Sajadi et al., *J Virol* 86, 5014-5025 (2012)). Serum antibodies from N60 were able to neutralize 90% of 118 multi-clade Tier 2/3 panel of viruses (Table 5). The duration of such neutralization potency and breadth over a 5-year period was confirmed by sequential testing of N60 plasma against a cross-clade, multi-tier panel of viruses (Table 6).

TABLE 5

Neutralization of N60 parent and affinity purified samples.

| | | | Titer in TZM.bl cells (ug/ml) | | |
|---|---|---|---|---|---|
| Virus ID | Clade* | Tier | N60 Pro IC50 | N60 IC50 | N60 IC50 |
| 6535.3 | B | 1B | 23.629 | 2.337 | 1.399 |
| QH0692.42 | B | 2 | 73.193 | 10.496 | 5.384 |
| SC422661.8 | B | 2 | 30.877 | 3.333 | 2.194 |
| PVO.4 | B | 3 | 23.164 | 1.478 | 1.005 |
| TRO.11 | B | 2 | 35.183 | 7.264 | 5.693 |
| AC10.0.29 | B | 2 | 27.920 | 4.144 | 3.550 |
| RHPA4259.7 | B | 2 | 14.971 | 3.373 | 2.257 |
| THRO4156.18 | B | 2 | 42.864 | 17.930 | 6.848 |
| REJO4541.67 | B | 2 | 21.061 | 4.071 | 3.186 |
| TRJO4551.58 | B | 3 | 72.808 | 16.072 | 13.344 |
| WITO4160.33 | B | 2 | 151.278 | 46.052 | 23.311 |
| CAAN5342.A2 | B | 2 | 30.870 | 4.007 | 3.148 |
| WEAU d15 410 787 | B (T/F) | 2 | 32.622 | 4.254 | 2.479 |
| 1006 11 C3 1601 | B (T/F) | 2 | 31.461 | 5.019 | 3.047 |
| 1054 07 TC4 1499 | B (T/F) | 2 | 104.772 | 27.878 | 10.870 |
| 1056 10 TA11 1826 | B (T/F) | 1B | 209.754 | 22.420 | 12.264 |
| 1012 11 TC21 3257 | B (T/F) | 1B | 39.521 | 3.783 | 2.738 |
| 6240 08 TA5 4622 | B (T/F) | 2 | 216.472 | 45.439 | 38.068 |
| 6244 13 B5 4576 | B (T/F) | 2 | 58.906 | 4.678 | 4.487 |
| 62357 14 D3 4589 | B (T/F) | 2 | 60.360 | 11.454 | 8.697 |
| SC05 8C11 2344 | B (T/F) | 2 | 28.437 | 4.712 | 3.912 |
| Du156.12 | C | 2 | 37.524 | 6.824 | 5.405 |
| Du172.17 | C | 2 | 119.944 | >50 | 38.171 |
| Du422.1 | C | 2 | 46.145 | 17.533 | 14.580 |
| ZM197M.PB7 | C | 2 | 28.614 | 14.055 | 4.300 |
| ZM214M.PL15 | C | 2 | 485.829 | >50 | >50 |
| ZM233M.PB6 | C | 2 | 169.452 | 21.342 | 20.248 |
| ZM249M.PL1 | C | 2 | 102.326 | 15.919 | 12.597 |
| ZM53M.PB12 | C | 2 | 25.867 | 10.571 | 6.323 |
| ZM109F.PB4 | C | 1B | 210.029 | >50 | 30.049 |
| ZM135M.PL10a | C | 2 | 260.838 | 32.686 | 21.300 |
| CAP45.2.00.G3 | C | 2 | 350.560 | >50 | >50 |
| CAP210.2.00.E8 | C | 2 | 367.728 | >50 | >50 |
| HIV-001428-2.42 | C | 2 | 25.972 | 2.701 | 2.187 |
| HIV-0013095-2.11 | C | 2 | 211.157 | 22.522 | 18.247 |
| HIV-16055-2.3 | C | 2 | 92.761 | 12.576 | 10.268 |
| HIV-16845-2.22 | C | 2 | 426.772 | >50 | 49.375 |
| Ce1086_B2 | C (T/F) | NC | 11.192 | >50 | 1.641 |
| Ce0393_C3 | C (T/F) | NC | 142.594 | 30.286 | 15.431 |
| Ce1176_A3 | C (T/F) | NC | 192.528 | 45.344 | 28.479 |
| Ce2010_F5 | C (T/F) | NC | 70.275 | 19.463 | 12.692 |
| Ce0682_E4 | C (T/F) | NC | 64.759 | 17.431 | 10.243 |
| Ce1172_H1 | C (T/F) | NC | >528 | >50 | >50 |
| Ce2060_G9 | C (T/F) | NC | >528 | >50 | >50 |
| Ce703010054_2A2 | C (T/F) | NC | 188.873 | 31.683 | 19.604 |
| BF1266.431a | C (T/F) | NC | 154.369 | 46.996 | 27.310 |
| 246F C1G | C (T/F) | NC | 352.889 | >50 | 48.226 |
| 249M B10 | C (T/F) | NC | 183.182 | 21.542 | 19.517 |
| ZM247v1(Rev-) | C (T/F) | NC | 190.864 | >50 | >50 |
| 7030102001E5(Rev-) | C (T/F) | NC | 33.817 | 3.270 | 3.724 |
| 1394C9G1(Rev-) | C (T/F) | NC | 59.578 | 16.555 | 5.566 |
| Ce704809221_1B3 | C (T/F) | NC | 65.767 | 35.580 | 10.697 |
| CNE19 | BC | NC | 16.594 | 2.854 | 1.520 |
| CNE20 | BC | NC | 15.633 | 4.173 | 1.565 |
| CNE21 | BC | NC | 91.501 | 22.960 | 14.653 |
| CNE17 | BC | NC | 139.056 | 21.438 | 13.846 |
| CNE30 | BC | NC | 221.349 | >50 | 40.694 |
| CNE52 | BC | NC | 56.900 | 7.694 | 5.036 |
| CNE53 | BC | NC | 20.570 | 3.483 | 2.635 |
| CNE58 | BC | NC | 22.749 | 4.549 | 2.858 |
| MS208.A1 | A | NC | 211.293 | >50 | 32.229 |
| Q23.17 | A | 1B | 17.575 | 2.938 | 1.794 |
| Q461.e2 | A | 2 | >528 | >50 | >50 |
| Q769.d22 | A | 2 | 35.201 | 6.293 | 3.506 |
| Q259.d2.17 | A | 2 | 33.807 | 7.060 | 3.559 |
| Q842.d12 | A | 2 | 18.917 | 3.348 | 2.180 |
| 0260.v5.c36 | A | NC | 80.819 | 13.873 | 43.483 |
| 3415.v1.c1 | A | 2 | 46.266 | 4.830 | 4.596 |
| 3365.v2.c2 | A | 2 | 54.620 | 8.493 | 5.802 |
| 191955_A11 | A (T/F) | NC | 288.049 | 41.777 | 43.183 |
| 191084 B7-19 | A (T/F) | NC | 34.834 | 4.607 | 1.917 |
| 9004SS_A3_4 | A (T/F) | NC | 18.058 | 2.144 | 1.965 |
| T257-31 | CRF02_AG | 3 | 426.998 | >50 | 43.480 |

TABLE 5-continued

Neutralization of N60 parent and affinity purified samples.

|  |  |  | Titer in TZM.bl cells (ug/ml) | | |
|---|---|---|---|---|---|
| Virus ID | Clade* | Tier | N60 Pro IC50 | N60 IC50 | N60 IC50 |
| 928-28 | CRF02_AG | 2 | >528 | >50 | >50 |
| 263-8 | CRF02_AG | 2 | 22.824 | 4.205 | 4.064 |
| T250-4 | CRF02_AG | 2 | 11.419 | 1.359 | 0.767 |
| T251-18 | CRF02_AG | 3 | 371.838 | >50 | 38.744 |
| T278-50 | CRF02_AG | 3 | >528 | >50 | >50 |
| T255-34 | CRF02_AG | 2 | 131.913 | 15.603 | 12.016 |
| 211-9 | CRF02_AG | 2 | 291.355 | 42.611 | 24.418 |
| 235-47 | CRF02_AG | 2 | 87.864 | 9.609 | 6.028 |
| 620345.c01 | CRF01_AE | NC | >528 | >50 | >50 |
| CNE8 | CRF01_AE | NC | 194.556 | 16.923 | 7.854 |
| C1080.c03 | CRF01_AE | NC | 483.323 | >50 | >50 |
| R2184.c04 | CRF01_AE | NC | 27.037 | 3.087 | 2.138 |
| R1166.c01 | CRF01_AE | NC | 130.381 | 29.864 | 24.622 |
| R3265.c06 | CRF01_AE | NC | 440.886 | >50 | >50 |
| C2101.c01 | CRF01_AE | NC | 92.755 | 14.543 | 16.106 |
| C3347.c11 | CRF01_AE | NC | 10.921 | 1.730 | 1.808 |
| C4118.c09 | CRF01_AE | NC | 117.159 | 17.416 | 16.615 |
| CNE5 | CRF01_AE | NC | 170.243 | 20.320 | 17.746 |
| BJOX009000.02.4 | CRF01_AE | NC | >528 | >50 | 44.993 |
| BJOX015000.11.5 | CRF01_AE | NC | 250.047 | >50 | 26.892 |
| BJOXO10000.06.2 | CRF01_AE | NC | >528 | >50 | >50 |
| BJOX025000.01.1 | CRF01 AE | NC | 328.505 | >50 | >50 |
| BJOX028000.10.3 | CRF01_AE | NC | >528 | >50 | >50 |
| X1193_c1 | G | NC | 121.508 | 3.302 | 13.356 |
| P0402_c2_11 | G | NC | 48.896 | >50 | 4.239 |
| X1254_c3 | G | NC | 159.002 | 8.668 | 11.873 |
| X2088_c9 | G | NC | >528 | >50 | >50 |
| X2131_C1_B5 | G | NC | 95.017 | 9.848 | 10.189 |
| P1981_C5_3 | G | NC | 90.229 | >50 | 14.873 |
| X1632_S2_B10 | G | NC | 110.495 | >50 | 16.335 |
| 3016.v5.c45 | D | NC | >528 | >50 | >50 |
| A07412M1.vrc12 | D | NC | 62.198 | >50 | 5.815 |
| 231965.c01 | D | NC | 171.994 | 20.212 | 26.544 |
| 231966.c02 | D | NC | 459.176 | >50 | >50 |
| 3817.v2.c59 | CD | NC | 58.502 | >50 | 6.729 |
| 6480.v4.c25 | CD | NC | 23.010 | 9.698 | 3.495 |
| 6952.v1.c20 | CD | NC | 89.351 | 2.925 | 15.998 |
| 6811.v7.c18 | CD | NC | 45.321 | >50 | 6.443 |
| 89-F1_2_25 | CD | NC | >528 | >50 | >50 |
| 3301.v1.c24 | AC | NC | 42.393 | 0.576 | 5.568 |
| 6041.v3.c23 | AC | NC | 15.836 | 1.476 | 2.412 |
| 6540.v4.c1 | AC | NC | 55.351 | >50 | 11.334 |
| 6545.v4.c1 | AC | NC | 113.948 | >50 | 35.556 |
| 0815.v3.c3 | ACD | NC | 26.284 | 1.644 | 4.530 |
| 3103.v3.c10 | ACD | NC | 215.876 | 17.045 | 30.725 |
| MuLV | Neg. | Neg. | >528 | >50 | >50 |

Pro A/G = Affinity purified antibody from a Protein A/G column; gp120 = Affinity purified antibody from a gp120 column; gp120-IgG1 = Affinity purified antibody from a gp120 followed by IgG1 column; IC50 = Inhibitory concentration 50 (ug/ml); T/F = transmitted/founder; NC = not characterized.

Plasma from patient N60 was purified and tested against a 118 multitier and multiclade pseudovirus panel. Parent sample demonstrates considerable breadth, which was also seen in the gp120 and gp120-IgG1 fractions.

TABLE 6

Plasma neutralization potency and breadth from 2008-2013. Plasma from patient N60 was tested against a panel of multiclade HIV pseudoviruses, demonstrating potency and breadth for more than 4 years. Numerical values given as ID50, the Inhibitory Dose 50.

|  |  |  | Plasma ID50 Titer in TZM.bl Cells (1/x) | | | |
|---|---|---|---|---|---|---|
| Virus | Tier | Clade | Oct. 1, 2008 | Oct. 12, 2009 | Sep. 9, 2010 | Jan. 10, 2013 |
| 6535.3 | 1B | B | 3,514 | 2,028 | 2,178 | 1,713 |
| QH0692.42 | 2 | B | 530 | 422 | 545 | 335 |
| SC422661.8 | 2 | B | 973 | 630 | 650 | 1,008 |
| PVO.4 | 3 | B | 1,384 | 548 | 800 | 2,046 |
| TRO.11 | 2 | B | 1,820 | 1,074 | 820 | 1,174 |
| AC10.0.29 | 2 | B | 3,655 | 1,884 | 1,709 | 1,586 |

TABLE 6-continued

Plasma neutralization potency and breadth from 2008-2013. Plasma from patient N60 was tested against a panel of multiclade HIV pseudoviruses, demonstrating potency and breadth for more than 4 years. Numerical values given as ID50, the Inhibitory Dose 50.

| | | | Plasma ID50 Titer in TZM.bl Cells (1/x) | | | |
|---|---|---|---|---|---|---|
| Virus | Tier | Clade | Oct. 1, 2008 | Oct. 12, 2009 | Sep. 9, 2010 | Jan. 10, 2013 |
| RHPA4259.7 | 2 | B | 1,988 | 1,543 | 3,259 | 2,089 |
| THRO4156.18 | 2 | B | 1,149 | 721 | 438 | 506 |
| REJO4541.67 | 2 | B | 2,112 | 1,576 | 1,133 | 2,143 |
| TRJO4551.58 | 3 | B | 269 | 479 | 395 | 728 |
| WITO4160.33 | 2 | B | 268 | 221 | 127 | 732 |
| CAAN5342.A2 | 2 | B | 6,032 | 2,197 | 1,367 | 1,906 |
| Du156.12 | 2 | C | NT | 1,000 | NT | 1,343 |
| Du172.17 | 2 | C | NT | 97 | NT | 468 |
| Du422.1 | 2 | C | NT | 636 | NT | 581 |
| ZM53M.PB12 | 2 | C | NT | 3,183 | NT | 1,715 |
| ZM135M.PL10a | 2 | C | NT | 221 | NT | 425 |
| ZM197M.PB7 | 1B | C | NT | 455 | NT | 1,062 |
| ZM214M.PL15 | 2 | C | NT | 412 | NT | 338 |
| Q23.17 | 1B | A | NT | 3,592 | NT | 2,895 |
| Q259.d2.17 | 2 | A | NT | 2,873 | NT | 1,528 |
| Q461.e2 | 2 | A | NT | 77 | NT | 184 |
| Q168.a2 | 2 | A | NT | 1,303 | NT | 942 |
| 3415.v1.c1 | 2 | A | NT | 1,097 | NT | 1,318 |
| 0439.v5.c1 | 2 | A | NT | 499 | NT | 588 |
| 0260.v5.c1 | 2 | A | NT | 3,519 | NT | 1,957 |
| 3365.v2.c20 | 2 | A | NT | 869 | NT | 1,425 |
| T257-31 | 3 | CRF02_AG | NT | 97 | NT | 316 |
| 263-8 | 2 | CRF02 AG | NT | 493 | NT | 1,104 |
| 211-9 | 2 | CRF02_AG | NT | 108 | NT | 780 |
| MuLV (Neg) | Neg control | Neg control | 24 | 30 | <20 | 186 |

NT = not tested

The broadly neutralizing plasma antibodies were isolated from N60 plasma by affinity chromatography with monomeric gp120 (Sajadi et al., *J Acquir Immune Defic Syndr* 57, 9-15 (2011); Sajadi et al., *J Infect Dis* 213, 156-164 (2016); Sajadi et al., *J Virol* 86, 5014-5025 (2012)) (Table 5). The recovered gp120 affinity fraction from N60 is known represent approximately 2% of the starting mass of IgG antibody. Similar recoveries (0.6%-2% of starting mass of IgG antibody) of anti-gp120 antibodies were obtained from the plasma of other HIV infected individuals. In accordance with our previous studies of anti-HIV humoral responses (Sajadi et al., *J Acquir Immune Defic Syndr* 57, 9-15 (2011); Sajadi et al., *J Infect Dis* 213, 156-164 (2016); Sajadi et al., *J Virol* 86, 5014-5025 (2012)), broadly neutralizing activity in N60 plasma was recovered by sequential protein A/G affinity chromatography, anti-gp120, and anti-IgG1 affinity chromatography (Table 5).

Two lines of evidence showed that few if any epitope specificities beyond those on monomeric gp120 were linked with the N60 polyclonal neutralizing response. First, the plasma antibody fraction that flowed through the gp120 affinity column exhibited negligible neutralization activity against a panel of 12 HIV Tier 1-3 pseudoviruses, compared to unfractionated plasma (Table 5). Second, the neutralizing breadth of purified N60 anti-gp120 IgG1 Ig largely matched that of unfractionated plasma (Table 5).

TABLE 7

ID50 and ID80 of N60 Plasma and gp120-FT. Plasma from patient N60 as well as gp120-FT (IgG that was passed over a BaL-gp120 column) was tested against a panel of HIV pseudoviruses for neutralization. Numerical values given as dilutions of the Inhibitory Dose 50 (ID50) or the Effective Dose 50 (ED50). In each case, the gp120-FT loses potency compared to the parent plasma, confirming that the fraction affinity purified against the gp120 monomer contains the bulk of neutralizing antibodies.

| | | N60 Plasma | | N60 gp120FT | |
|---|---|---|---|---|---|
| Virus ID | Tier | ID50 | ID80 | ID50 | ID80 |
| BaL.26 | 1B | 1,968 | 574 | <40 | <40 |
| QH0692.42 | 2 | 549 | 119 | <40 | <40 |
| SC422661.8 | 2 | 752 | 276 | <40 | <40 |
| PVO.4 | 3 | 905 | 308 | 55 | <40 |
| TRO.11 | 2 | 794 | 298 | 52 | <40 |
| AC10.0.29 | 2 | 1,040 | 335 | <40 | <40 |
| RHPA4259.7 | 2 | 1,863 | 608 | <40 | <40 |
| THRO4156.18 | 2 | 361 | 90 | 51 | <40 |
| REJO4541.67 | 2 | 919 | 333 | <40 | <40 |
| TRJO4551.58 | 3 | 293 | 102 | 66 | <40 |
| WITO4160.33 | 2 | 164 | 45 | <40 | <40 |
| CAAN5342.A2 | 2 | 851 | 360 | <40 | <40 |
| MuLV | Neg control | 80 | <40 | <40 | <40 |

We have previously shown a light chain bias exists in the anti-HIV envelope response (Sajadi et al., *J Infect Dis* 213, 156-164 (2016)), so to better define the N60 neutralizing antibodies, affinity purified anti-gp120 plasma antibodies were further fractionated by affinity chromatography with antibodies selective for human κ or λ light chains. The bulk anti-gp120 IgG1 κ or λ Ig preparations were further subjected to free flow isoelectric focusing (FFE) to separate individual antibody species according to their pI. In our previous study (Sajadi et al., *J Virol* 86, 5014-5025 (2012)), the broadly neutralizing antibodies were localized to fractions with more basic pIs. In the current study the fractions were tested for neutralization against two Tier 2 pseudoviruses, confirming the localization of broadly neutralizing antibodies to the basic fractions (FIG. 1 and data not shown). ELISAs confirmed that the broadly neutralizing antibody fractions contained IgG reactive with gp120 and gp120 core; but were less reactive with FLSC, in which the CD4 binding site is blocked, and did not bind to D368R gp120, whose single point mutation at position 368 abrogates binding of CD4-BS antibodies to HIV-1 gp120 (FIG. 1) (Li et al., *Nat Med* 13, 1032-1034 (2007)). In comparison, more acidic fractions favored binding to gp120, FLSC, D368R gp120, but not the YU2-core. (FIG. 1) (Li et al., *Nat Med* 13, 1032-1034 (2007)).

Our basic strategy for deconvoluting the plasma anti-gp120 polyclonal response proceeded as follows. First, fractionated immunoglobulin (see below) was subjected to enzymatic digestion with trypsin, chymotrypsin, and/or Glu-C (see Methods). Peptide fragments were subjected to LC-MS to calculate mass assignments, from which their amino acid sequences could be deduced. Next, the peptide sequences were used to identify the Ig H and L chain genes from which they originated based on a selection algorithm (see below). Identified genes then served as a means to artificially reproduce each plasma anti-gp120 monoclonal antibody, which could be examined under various conditions.

Figure 2:
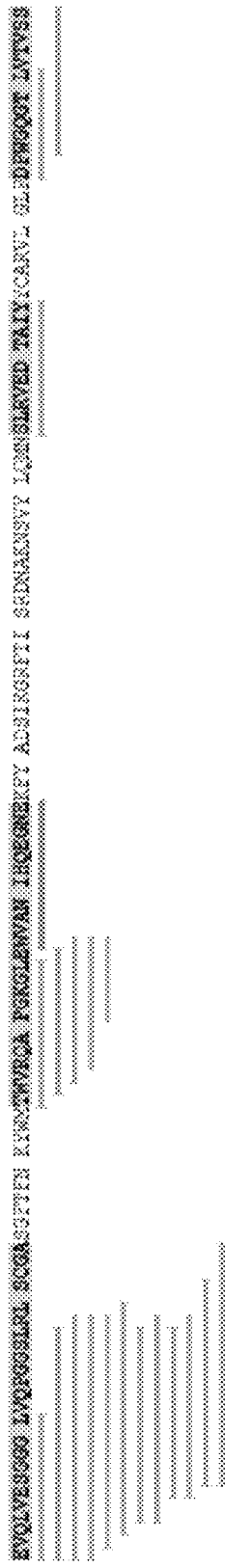
FIG. 2. Comparison of Heavy chains from 2 antibodies based on unique peptides. After digestion of affinity purified samples from N60, samples run through LC-MS and analyzed with patient specific database (see Example 1 methods). Orange and blue bars represent unique and non-unique peptide sequences. Grey shading of the protein sequence shows areas covered by peptide sequence. In panel A, the peptide matches are restricted to the framework regions and include only one unique peptide. This mAb did not bind or neutralize HIV. In contrast, in panel B, the there are multiple unique peptides, including coverage of the hypervariable region. This mAb, N60P2.1 bound and neutralized HIV.

Peptide sequences were aligned and assembled using as templates authentically paired Ig H and L chain amino acid sequences translated from an N60-specific Ig gene database (see Methods) derived by single-cell sequencing from bone marrow mononuclear cells and circulating plasmablasts (see Methods). One caveat to the alignment operation was that certain peptides (typically from framework regions) could redundantly align with multiple Ig H and L template pairs, thus creating random peptide assemblages. This confound was mitigated by rank ordering the Ig H and L templates according to the number of "unique" peptide alignments (i.e. did not occur match any other Ig sequence in the database; see Methods for details) they comprised. False discovery rates were held at 5% to further increase the probability that peptide sequences were properly grouped and aligned within a full length Ig sequence (see Methods). It was also important to consider that similar degrees of total template "coverage" by plasma amino acid sequences could differ substantially in the numbers of unique peptide alignments. An example of this caveat is shown in FIG. 2 with respect to H chain alignments. In both cases, there is good overall coverage, the heavy chain in FIG. 2A possessing 60% coverage by 21 peptides, and the heavy chain in FIG. 2B possessing 69% coverage derived by 25 peptides. The heavy chain in FIG. 2A matches but only one unique, template-specific alignment (pink). The other covered areas (blue) involve sequences that bind multiple Ig gene templates, mostly in the framework regions. Alignments such as these were taken as false sequence assemblages. Indeed, antibody proteins reconstructed from such cases did not neutralize HIV or bind HIV envelope (not shown). Conversely, FIG. 2B represents a case where the alignment includes multiple peptides unique to the template sequence (including the CDRH1 region). Further, unique peptide matches were favored over redundant ones. These characteristics were taken to indicate valid sequence assemblages. In agreement, the antibody constructed from the Ig H and L template pair represented in FIG. 2B bound gp120 (N60P2.1) and was broadly neutralizing (see below).

Figure 3:
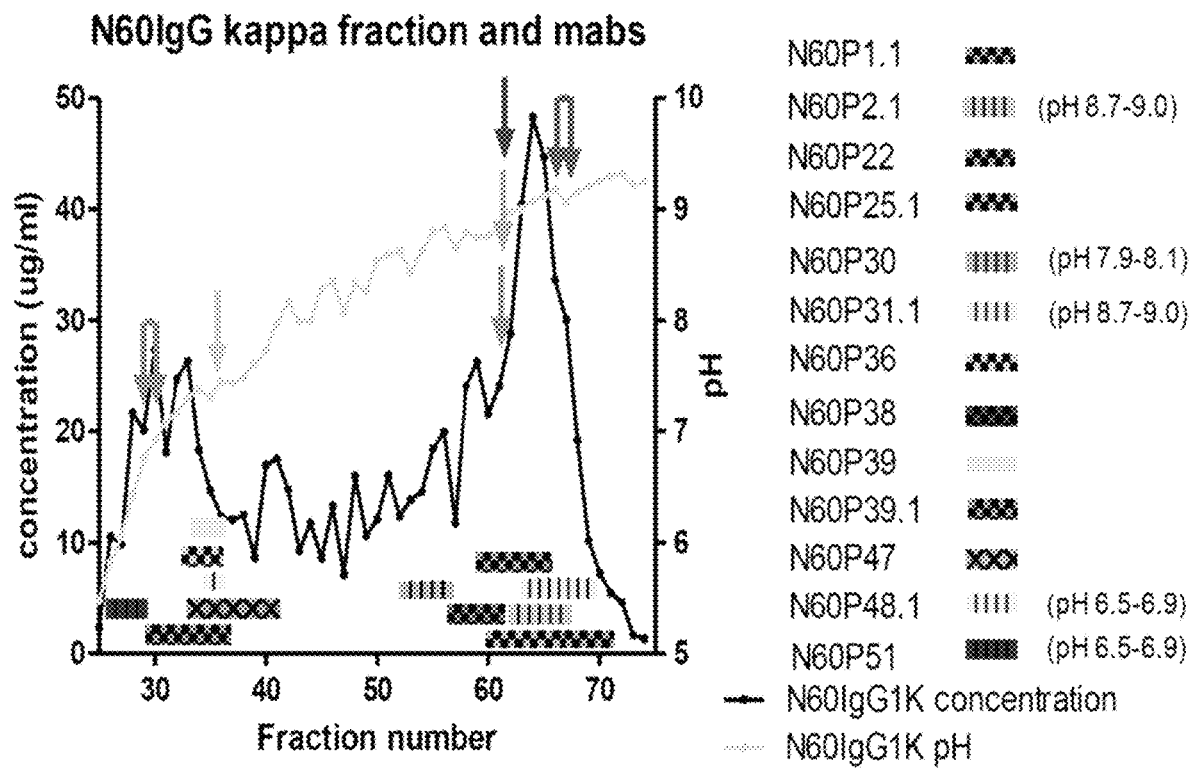
FIG. 3. Free flow electrophoretic fractionation of N60 plasma anti-gp120 polyclonal antibodies and reconstructed anti-gp120 mAbs. The gray line indicates the pH (right Y axis) gradient across the fractions created by the FFE procedure. Anti-gp120 κ light chain (top) or anti-gp120 λ light chain (bottom) polyclonal plasma antibody preparations were processed separately (see Example 1 text and methods). The plasma antibody protein concentrations (left Y axis) detected across fractions are shown by the black trace. FFE analyses of identified and reconstructed mAbs (see Example 1) are depicted by horizontal bars. Bar width spans 75-85% of the total amount of antibodies in the FFE fraction, as determined by Elisa. Eight mAbs (checkered bars) were identified by evaluating peptides from individual FFE fractions of bulk polyclonal anti-gp120 plasma antibodies. The FFE fraction reflecting the most coverage and unique peptide pairings is indicted for each mAb by a matched-color arrow. Five additional mAbs (hatched colored bars) were identified by evaluating peptides from IEF gel fractionation of the bulk plasma antibodies. Searches using peptides digested from bulk plasma anti-gp120 antibodies identified 1 additional mAbs (solid colored bars). One other mAb (criss-cross colored bars) was identified by homology search of the Ig gene database. The pH gradient shown is for the polyclonal N60IgG1 anto-gp120 κ fraction; pH gradients from each monoclonal run overlapped the trace shown, with a variance of up to 0-5 fractions in either direction.
Figure 3:
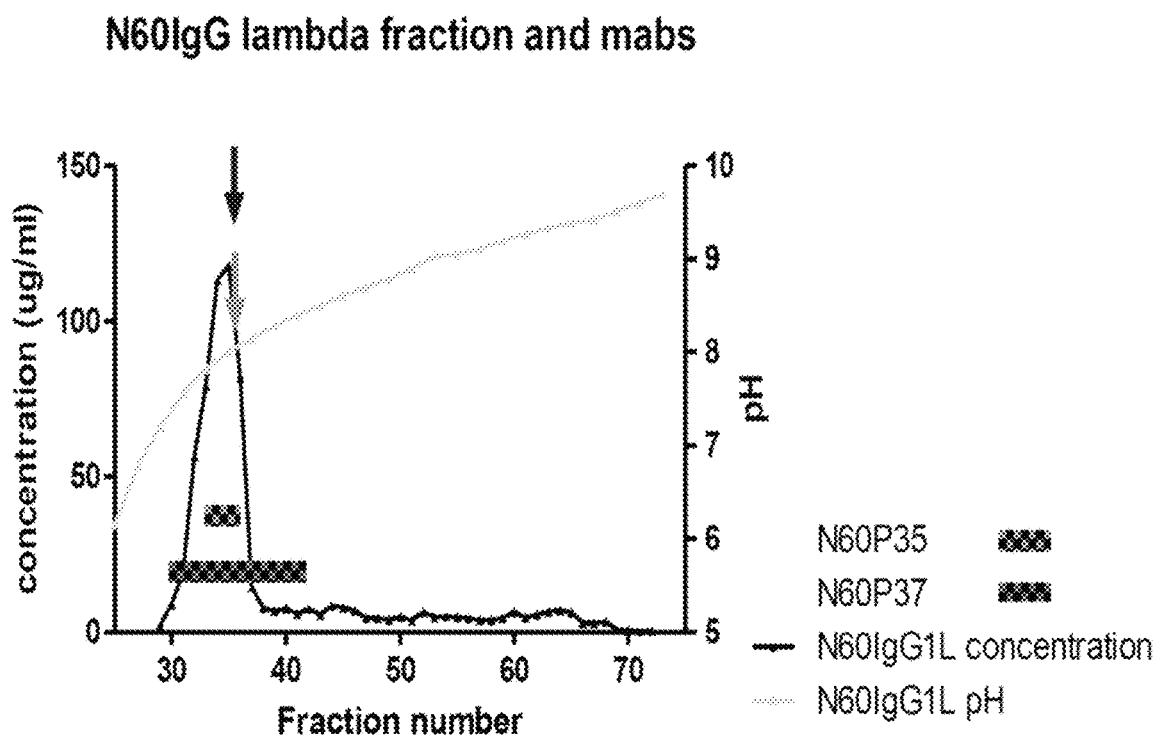

The selection algorithm was applied to peptide sequences derived from three complementary fractionation approaches (FIG. 3). The criteria for identifying an H and L template pair as the genetic source of a plasma antibody was ≥4 unique peptides and 50% coverage in at least one of the H and L chain of each pair (with ≥4 unique peptides required in each H and L chain for the combined fractions), accommodating the designated false discovery rate cutoff.

In the primary approach, FFE fractions of anti-gp120 plasma antibodies were evaluated individually to score and select corresponding H and L template pairs. As expected, adjacent fractions rendered similar determinations within certain portions of the FFE fraction series. This operation identified 8 paired H and L Ig genes encoding plasma antibodies targeting 3 epitopes. A second approach applied the bulk polyclonal anti-gp120 antibodies to preparative IEF gels. Immunoglobulins were extracted from sequential slices of the gels and digested to obtain peptide sequences, which were then compared against the entire Ig gene database. This operation identified all but one of the H and L sequence pairs found in the primary approach as well as 4 additional ones. A third approach generated peptides and their corresponding sequences directly from bulk anti-gp120 plasma antibodies and combining this with the gel digests. This exercise mitigated the risk that sequences were overlooked in the other methods due to protein loss but necessitated combining 27 separate digests. This approach identified most of the same H and L sequence pairs found by the other approaches (missing 2 but identifying 1 additional one).

The Fab sequences of the 14 identified H and L gene pairs were combined with a generic IgG1 Fc domain (CH1-3 from IGHG1*03) in order to construct synthetic monoclonal antibody expression plasmids from which to generate protein (Guan et al., *Proc Natl Acad Sci USA* 106, 3952-3957 (2009); Guan et al., *Proc Natl Acad Sci USA* 110, E69-78 (2013)). This construction strategy was appropriate, as the native plasma neutralizing antibodies were of the IgG1 isotype (Table 5).

FFE was then used to compare the electrophoretic behaviors of the reconstructed mAbs versus bulk polyclonal anti-gp120 plasma antibodies. As shown in FIG. 3, the plasma antibodies tended to elute at highest concentrations within two series of fractions peaking at lower and higher pH ranges in the gradient (which ranged pH 6.5 to pH 9.5). Fractions containing plasma antibody peptide/sequences that facilitated mAb reconstruction (see above and Methods) overlapped these regions. In the case of IgG κ, certain fractions near the center of the gradient (~45-55) did not yield any unique antibodies (the peptides that derived from this region did match some of the neighboring mAbs on either side, but at a lower frequency). Similarly for IgG λ, fractions above pH 8 contained too little protein to perform downstream analysis. Importantly, the pI values of the reconstructed mAbs derived from the FFE or gel isoelectric focusing approaches corresponded to those of the plasma fractions that yielded their identifying peptides (compare bars and arrows in FIG. 3). This consistency indicated that the identified and reconstructed mAbs contained assemblages of amino acid sequences authentic to the plasma antibodies.

Figure 4:
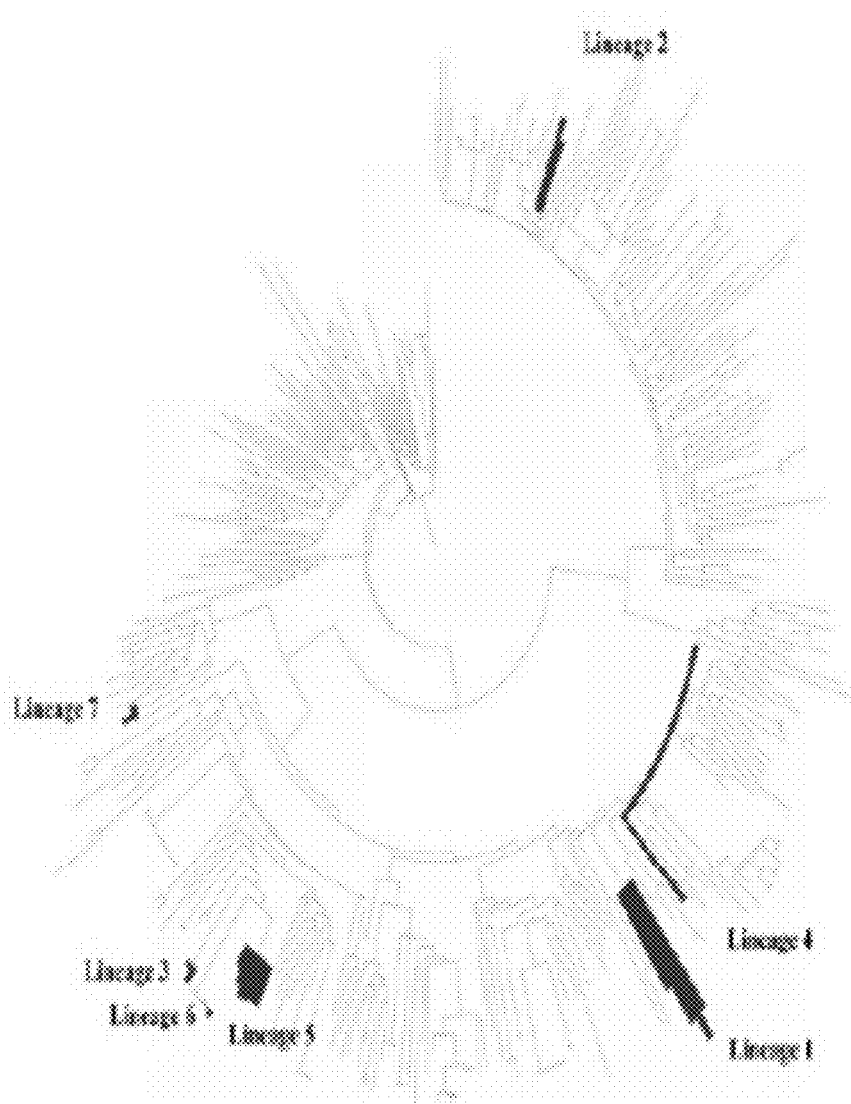
FIG. 4. Dendrogram of variable region of all NVS60 antibodies derived from single-cell sequencing from the bone marrow. The antibodies isolated from 2013 grouped into 7 distinct families. Two families of CD4-BS antibodies were identified. The anti-gp120 antibodies represented 3.2% of all antibodies in the bone marrow database. Lineage 1 and 2 are CD4-binding site antibodies. Lineages 3-6 are CD4-induced antibodies, while Lineage 7 are variable loop 3 antibodies.

The reconstructed mAbs were characterized for source-cell subset and lineage relationships (Table 8, FIG. 4). All of the anti-gp120 mAb sequences were found in bone marrow 138- and 138+ populations by single cell PCR (summarized in Table 8). Only one mab (N60P22) could be detected in the circulating plasmablast population (Table 8). This mAb had the second highest frequency of any in the bone marrow, so it could be that the frequency of the mAbs in the plasmablast population is less than the bone marrow, or they can only be detected for a short time, as occurs with vaccination or acute infections. A homology search (multiple sequence alignment) of the bone marrow database did not reveal any of the ancestral forms of any of the mAbs identified, implying that even though the mAbs were found in all bone marrow compartments, including the long-lived plasma cells (CD138+, CD19−), their longevity may be limited.

Figure 6:
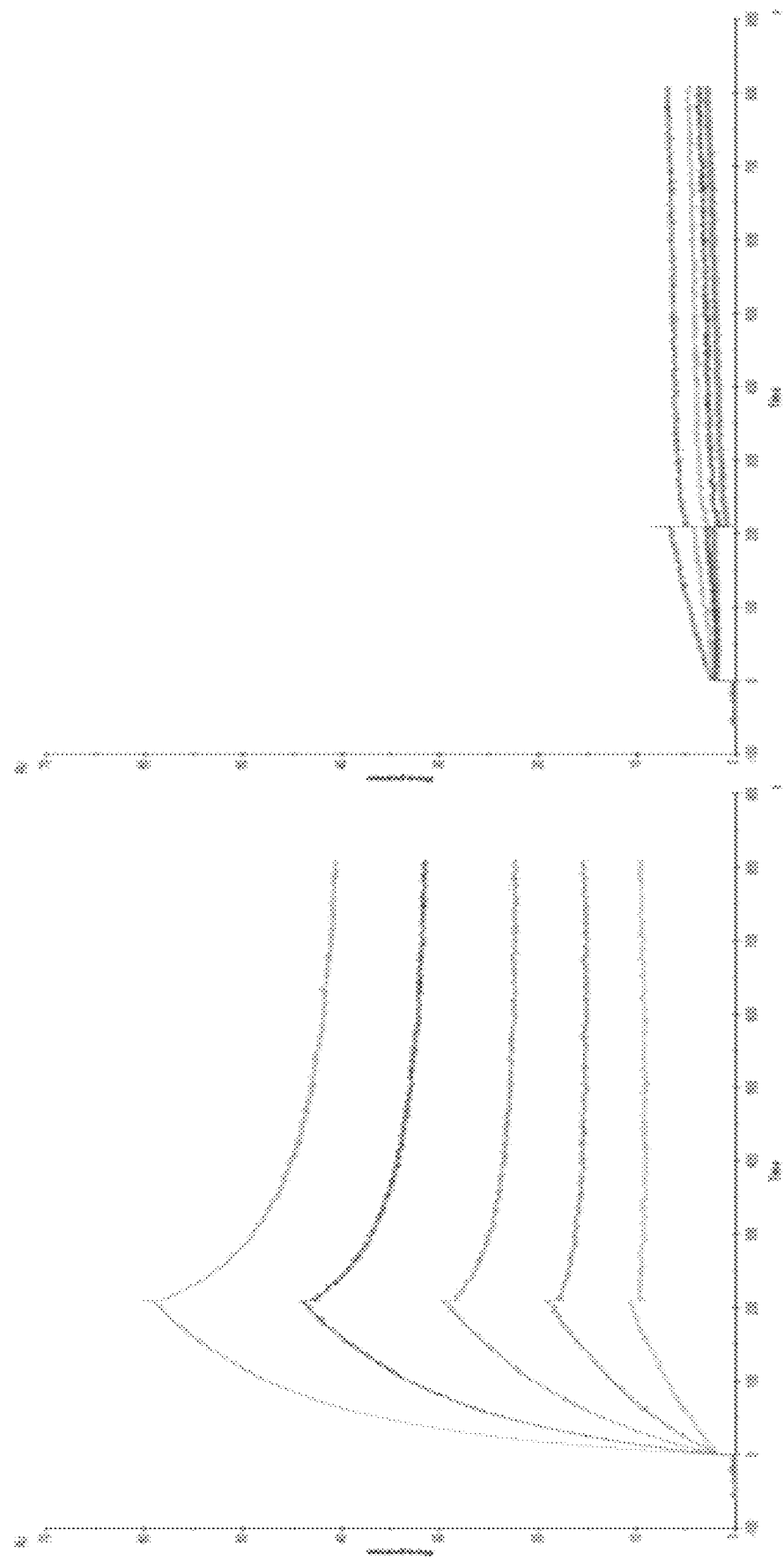
FIG. 6. Surface plasmon resonance analysis of N60 Lineage 1 mAbs to HIV envelope antigens. The binding kinetics for BaL-gp120 or D368R with mAb captured on Protein A-coated chips are shown. Data sets with significant dose response were globally fit to a 1:1 binding model to obtain the kinetic parameters of the binding. Three of the mAbs tested bound to gp120 monomer but exhibited weak binding to D368R. The other mAb demonstrated no binding to BaL gp120 or D368R.
Figure 6:
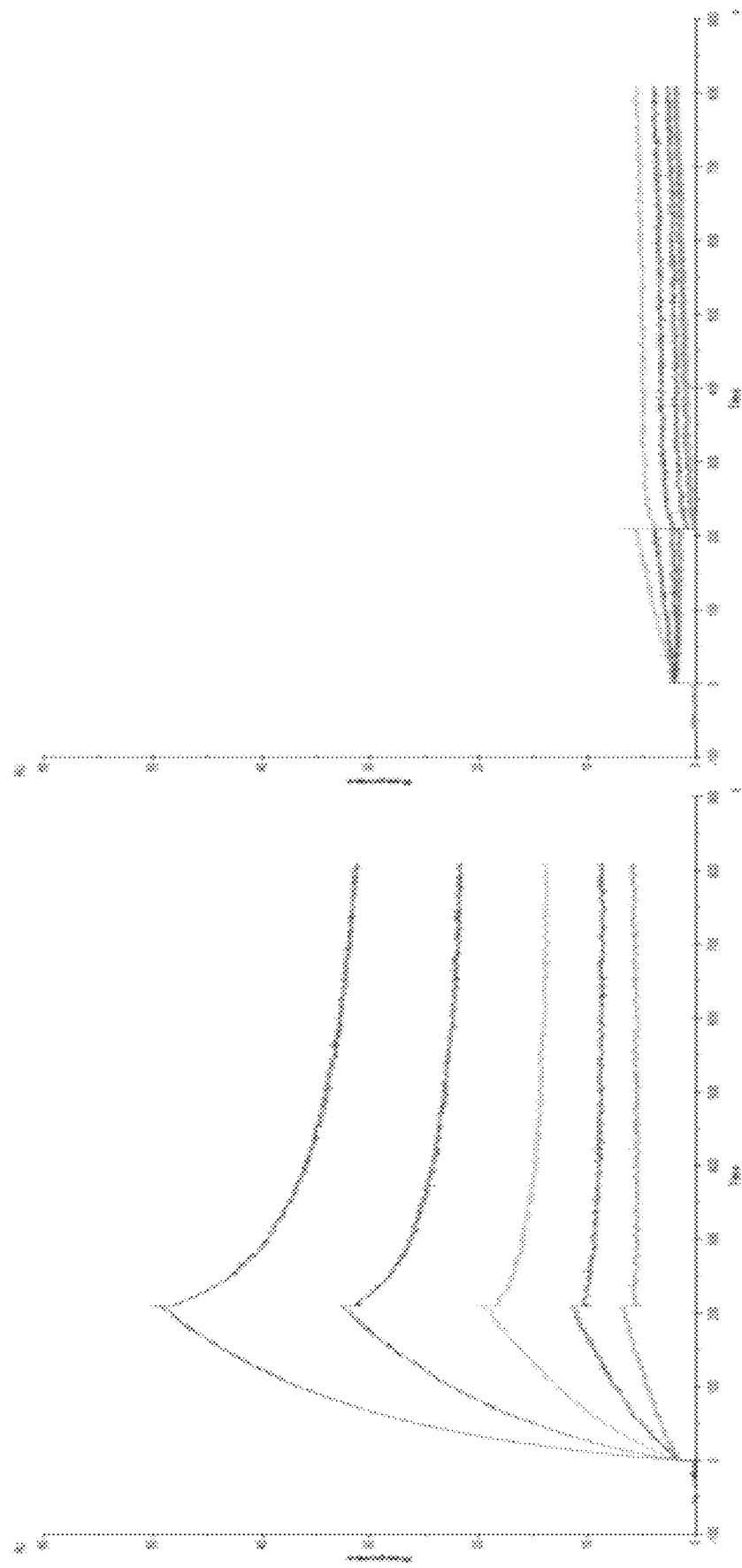
Figure 6:
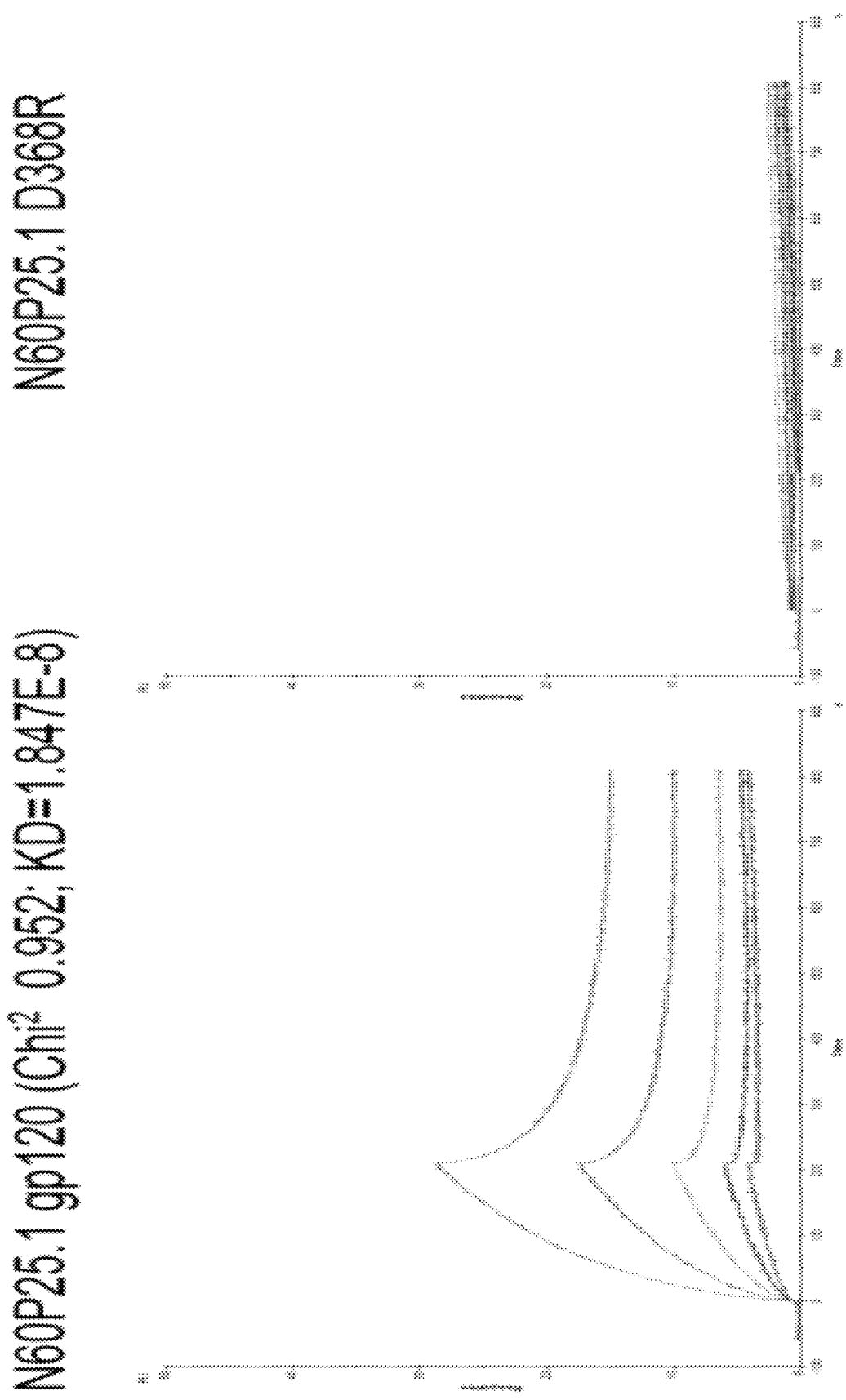
Figure 6:
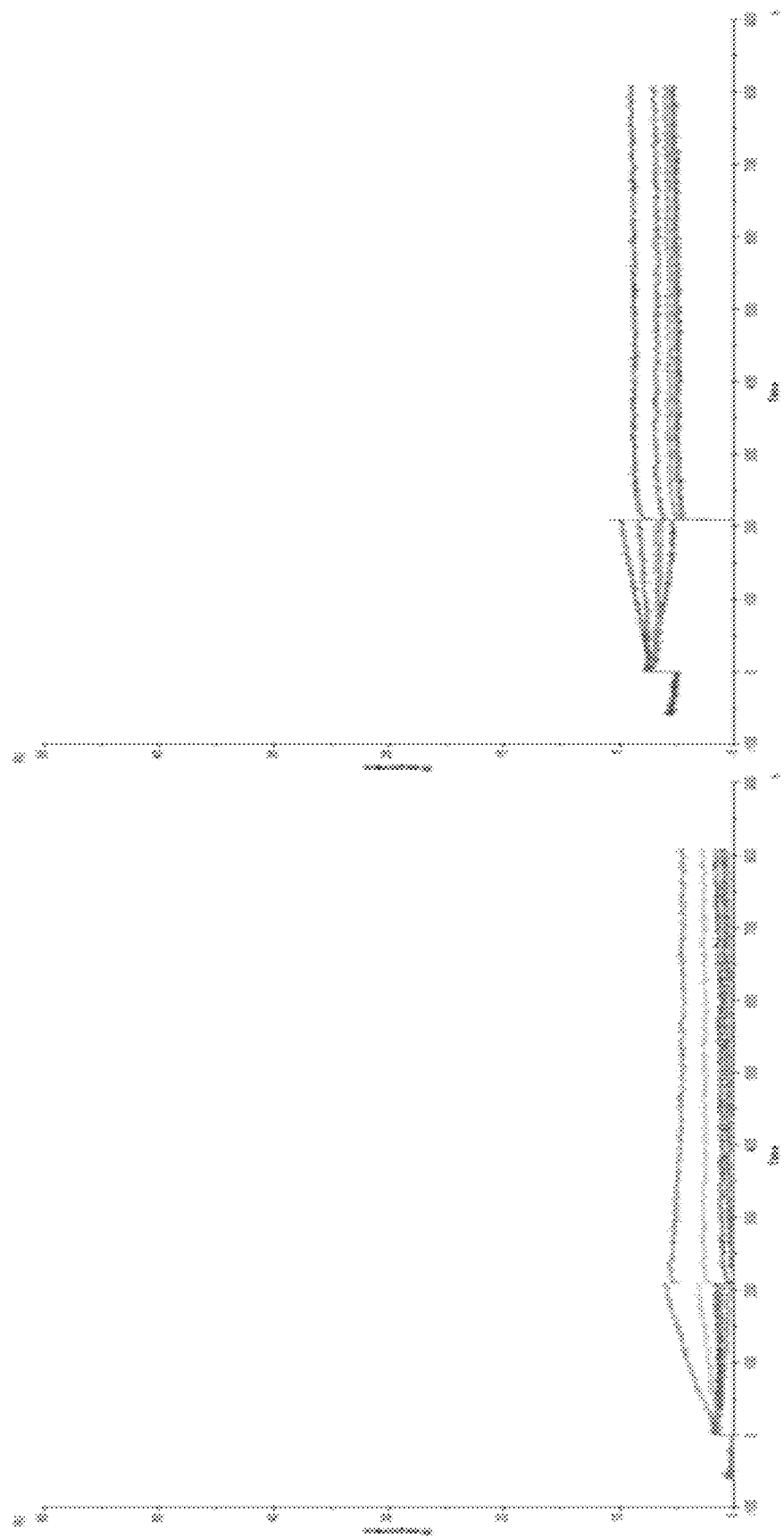

*J Virol* 86, 5014-5025 (2012); Guan et al., *Proc Natl Acad Sci USA* 106, 3952-3957 (2009)), nor in the reverse format coating plates first with mAbs (not shown). N60P25.1, when bound to protein A, did bind to gp120 in SPR, while N6031.1 did not (FIG. 6). Additionally, we did see binding to gp120 in accordance with their retention on the gp120 affinity column (26% recovery for N60P25.1, 5% recovery for N60P31.1, <1% for control mAb Synagis).

Lineage 2 was distinguished by 4-31 heavy chain and 3-20 κ light chain usage and a much lower degree of hypermutation (9% in the heavy chain). The two members of

TABLE 8

Characteristics of anti-gp120 plasma antibodies isolated.

| | mAb | Epitope | Heavy Chain | Light chain | SHM (Heavy/ Light) | Frequency of CDR3 (per 1000) Single Cell Sequencing | | |
|---|---|---|---|---|---|---|---|---|
| | | | | | | Peripheral plasmablast | Bone marrow 138− | Bone marrow 138+ |
| Lineage 1 | N60P2.1 | CD4-BS | 1-2 | κ 1-5 | 38%/29% | 0 | 2.48 | 0 |
| | N60P1.1 | CD4-BS | 1-2 | κ 1-5 | 36%/26% | 0 | 2.48 | 1.62 |
| | N60P25.1 | CD4-BS | 1-2 | κ 1-5 | 33%/26% | 0 | 2.48 | 0 |
| | N60P31.1 | CD4-BS | 1-2 | κ 1-5 | 42%/35% | 0 | 2.48 | 0 |
| Lineage 2 | N60P22 | CD4-BS | 4-31 | κ 3-20 | 9%/11% | 1.62 | 2.48 | 9.69 |
| | N60P38 | CD4-BS | 4-31 | κ 3-20 | 9%/11% | 0 | 2.48 | 0 |
| Lineage 3 | N60P30 | CD4i (Cluster A) | 1-2 | κ 3-20 | 21%/12% | 0 | 2.48 | 0 |
| Lineage 4 | N60P36 | CoR-BS (Cluster C) | 1-69 | κ 3-20 | 11%/9% | 0 | 4.96 | 4.85 |
| Lineage 5 | N60P39 | CoR-BS (Cluster C) | 1-69 | κ 3-20 | 11%/9% | 0 | 2.48 | 1.62 |
| | N6039.1 | CoR-BS (Cluster C) | 1-69 | κ 3-20 | 11%/9% | 0 | 2.48 | 1.62 |
| | N60P47 | CoR-BS (Cluster C) | 1-69 | κ 3-20 | 16%/6% | 0 | 2.48 | 0 |
| | N60P48 | CoR-BS (Cluster C) | 1-69 | κ 3-20 | 15%/6% | 0 | 4.96 | 6.46 |
| Lineage 6 | N60P51 | CoR-BS (Cluster C) | 1-69 | κ 3-20 | 20%/9% | 0 | 12.4 | 3.38 |
| Lineage 7 | N60P35 | V3 | 5-51 | λ 6-57 | 18%/14% | 0 | 2.48 | 4.85 |
| | N60P37 | V3 | 5-51 | λ 6-57 | 17%/16% | 0 | 2.48 | 6.46 | mAb = monoclonal antibody.
SHM = somatic hypermutation.
CD4-BS = CD4-binding site antibody.
CoR-BS = Co-Receptor binding site antibody.
Cluster A = competes with A32.
Cluster C = competes with 19e and/or 17b.

Figure 5:
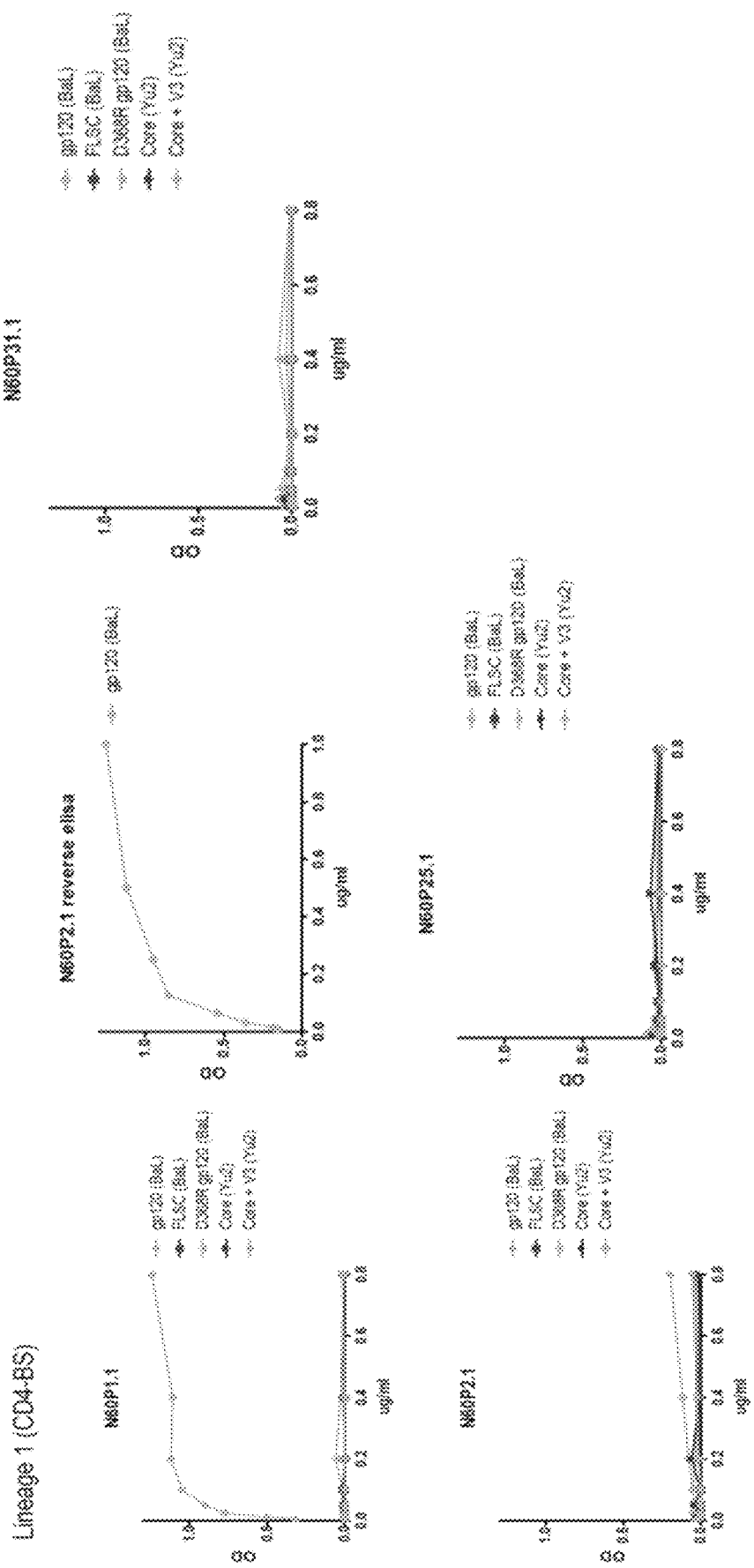
FIG. 5. ELISA Reactivity of the 7 families of antibodies isolate. Representative examples of each family is given. Dilutions of each mAb was tested by ELISA for reactivity against the indicated HIV antigens: BaL-gp120 monomer, BaL-gp120 monomer with the D368R mutation to abrogate CD4-BS binding, Yu2 gp120 core, Yu2 gp120 core+V3, and full length single chain (FLSC), presenting a full length CD4-induced gp120 structure in which the CD4-BS is occupied. N60P35 and N60P37 were also tested against the Complete V3 Loop Peptide. X-axis shows mAb concentration in ug/ml, and Y axis the background-subtracted OD. CD4-BS=CD4-binding site antibody. CoR-BS=Co-Receptor binding site antibody. CD4i=CD4-induced.
Figure 5:
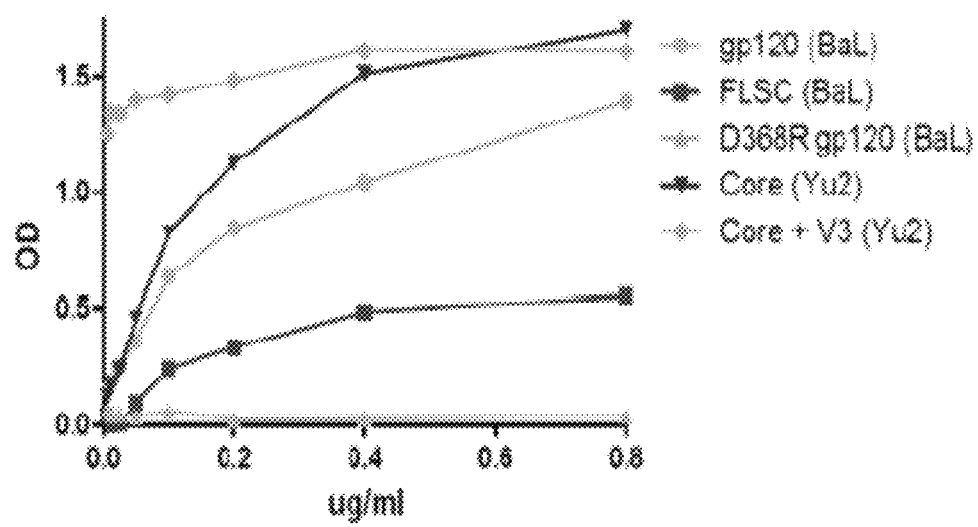
Figure 5:
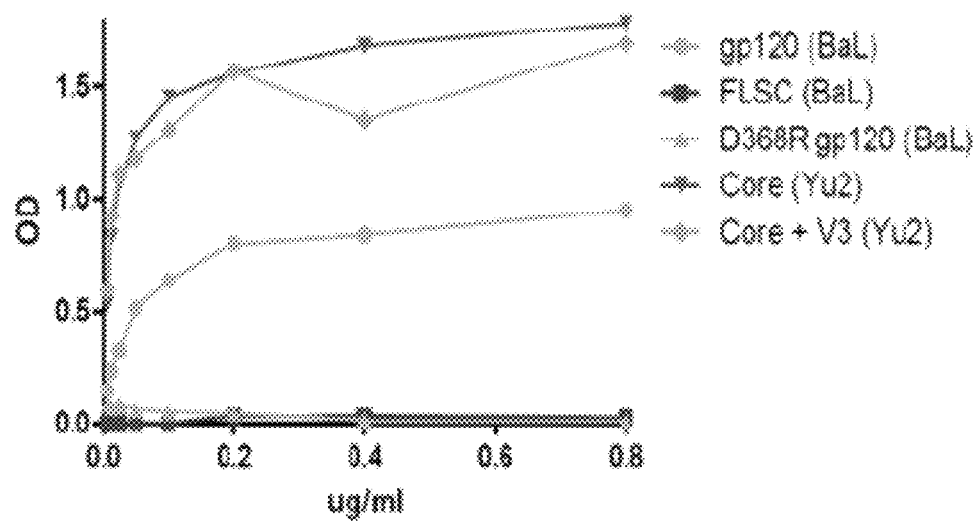
Figure 5:
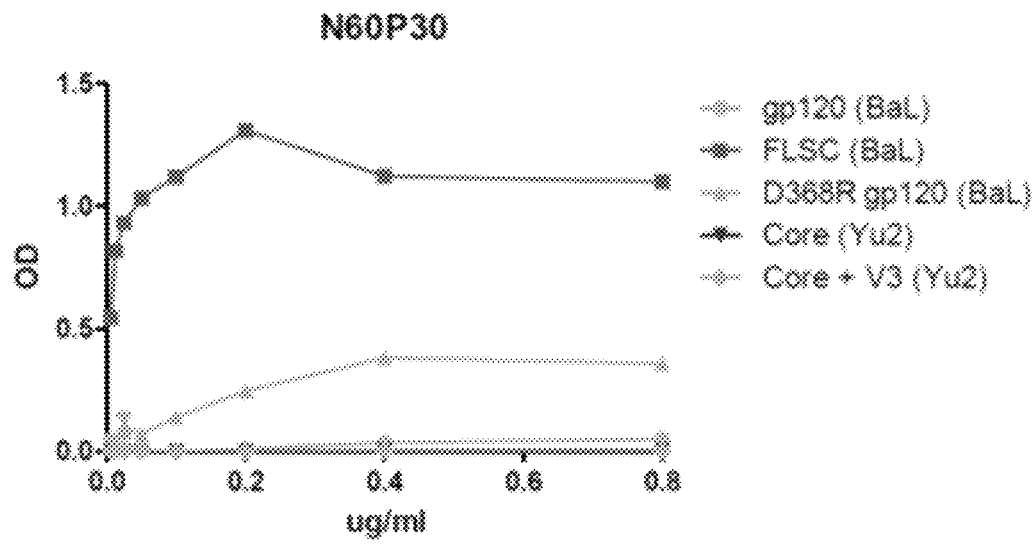
Figure 5:
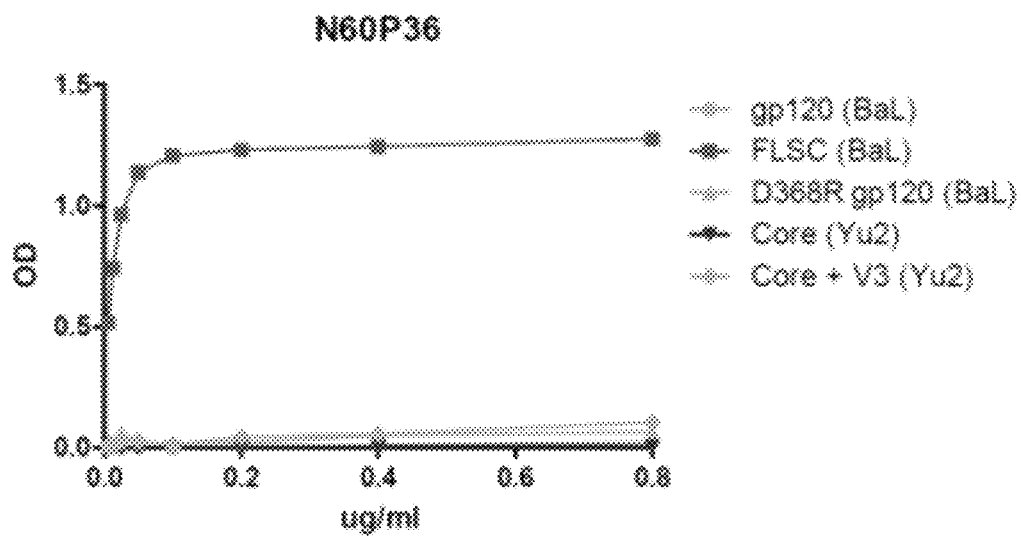
Figure 5:
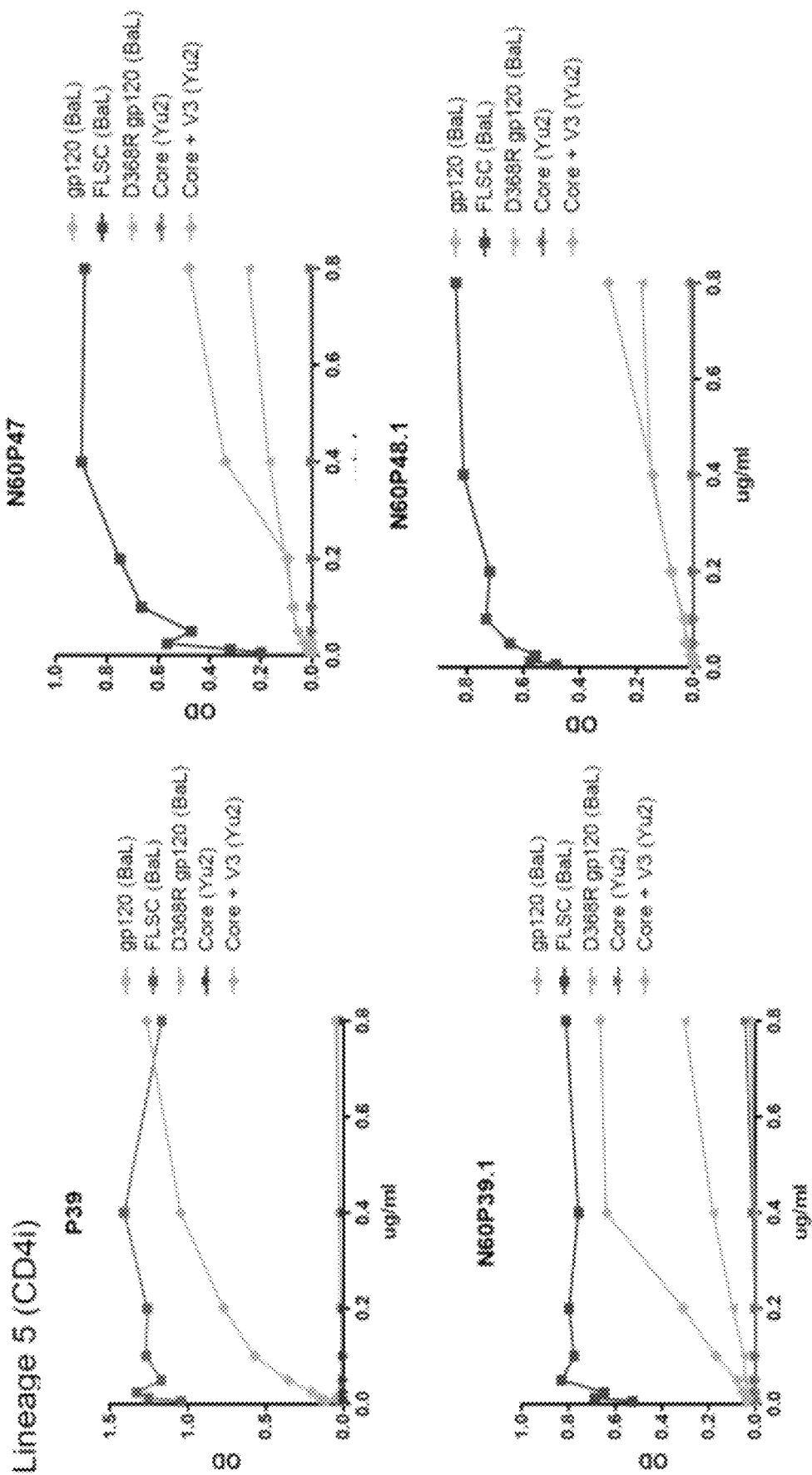
Figure 5:
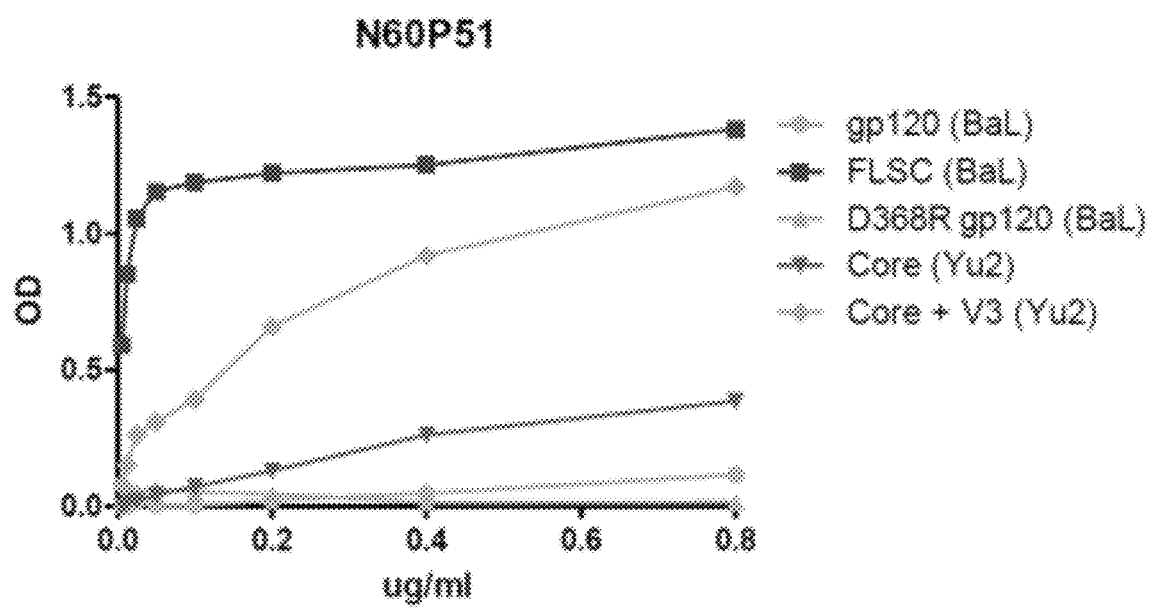
Figure 5:
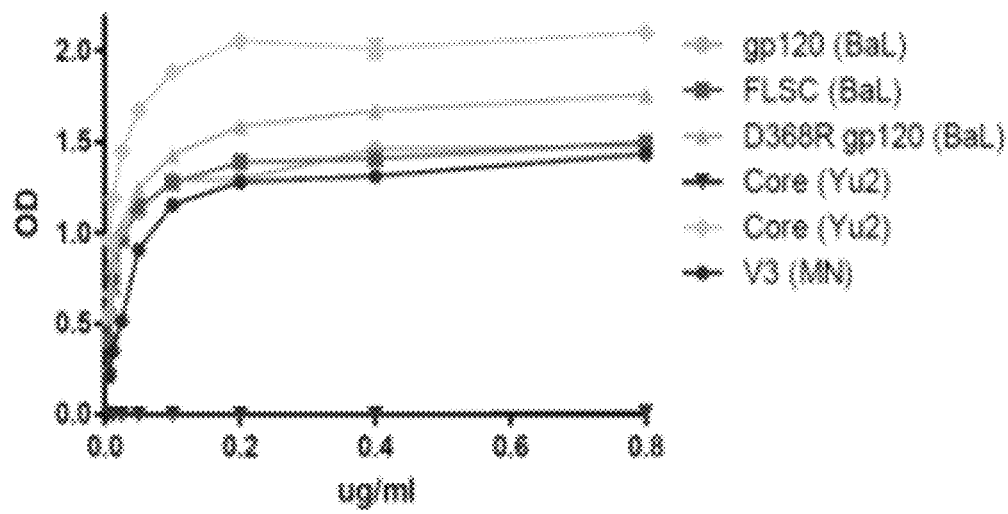
Figure 5:
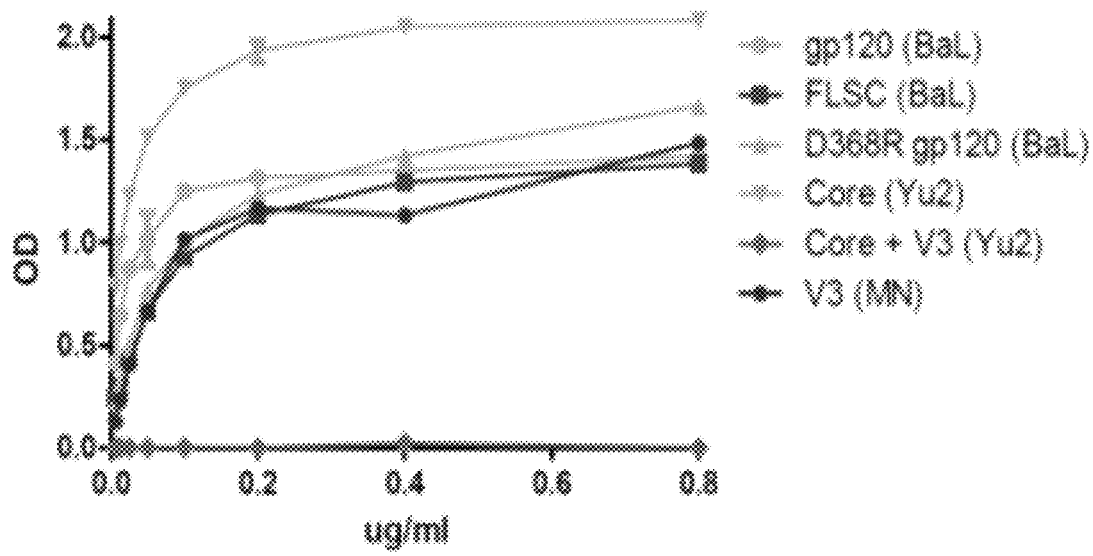

Overall, the dominant N60 plasma anti-gp120 response arose from 7 distinct lineages (Table 8), as shown in the neighbor-joining phylogeny tree (see Methods) of the entire BM antibodies (FIG. 4). Lineage 1 was distinguished by 1-2 heavy chain and 1-5 κ light chain gene usage as well as a relatively high degree of somatic hypermutation (33-42% in the heavy chain). Lineage 1 mAbs resemble previously reported broadly neutralizing anti-CD4-BS antibodies, which are also assigned to VH1-2 and W1-5 gene families that exhibit the signature deletion in the CDRL3 (Scharf et al., *Proc Natl Acad Sci USA* 110, 6049-6054 (2013); West et al., *Proc Natl Acad Sci USA* 109, E2083-2090 (2012); Zhou et al., *Science* 329, 811-817 (2010)). These antibodies had basic pIs. Two mAbs (N60P1.1 and N602.1) bound gp120 on Elisa and SPR, and but not the D368R point mutant, and thus are CD4 binding site antibodies (FIGS. 5 and 6). However, mAbs N60P25.1 and N60P31.1 in this family did not bind gp120 in the standard antigen capture ELISA format (FIG. 5) using plates coated with antibody D7324 directed against the gp120 C terminal region (Sajadi et al., *J Acquir Immune Defic Syndr* 57, 9-15 (2011); Sajadi et al., this lineage also had basic pIs and appeared to be directed against the CD4 binding site (FIGS. 5 and 6) as determined by ELISA (FIG. 5). These mAbs were distinguished from Lineage 1 antibodies by the capacity to recognize a YU2 gp120 core antigen. Genes encoding one mAb in this lineage (mAb N60P22) were detected in circulating plasmablasts.

Lineage 3 contained one member (mAb N60P30) with 1-2 heavy chain and 3-20 κ light chain usage and a moderate degree of hypermutation (21% in the heavy chain). N60P30 had a basic pI, bound well to FLSC, but not to gp120 or YU2-core in ELISA (FIG. 5), indicating a specificity for CD4-induced epitopes. Competition Elisa testing revealed that N60P30 competed with A32 but not 17b, signifying Cluster A specificity (data not shown).

Lineage 4 contained one member (mAb N60P36) with 1-69 heavy chain and 3-20 κ light chain usage and a relatively low degree of hypermutation (11% in the heavy chain). N60P36 had a neutral pI. Binding assays (FIG. 5) and competition ELISAs with CD4i mAbs (data not shown) indicated that mAbs in this lineage recognize the Cluster C epitope in the coreceptor binding site.

Lineage 5 mAbs were distinguished by 1-69 heavy chain and 3-20 κ light chain usage and a moderate degree of hypermutation (11-16% in the heavy chains). This Lineage comprised of 3 members (mAbs N60P39, N60P39.1, and N60P48). Binding assays (FIG. 5) and competition ELISAs with CD4i mAbs (data not shown) indicated that mAbs in this lineage recognize the Cluster C epitope in the coreceptor binding site. We identified one additional mAb that was not picked up with the above methods by a homology search of the bone marrow database. This mAb (N60P47) had no binding to gp120 on elisa, and thus had either no binding to gp120, as in the case of antibodies targeted at the hybrid epitope of CD4 and gp120, or bound to gp120 so weakly that too little was recovered to identify correctly.

Lineage 6 contained one member (mAb N60P51) with 1-69 heavy chain and 3-20 κ light chain usage and a moderate degree of hypermutation (20% in the heavy chain). Binding assays (FIG. 5) and competition ELISAs with CD4i mAbs (data not shown) indicated recognition of Cluster C epitope in the coreceptor binding site.

Lineage 7 was distinguished by 5-51 heavy chain and 3-20 λ light chain usage and a moderate degree of hypermutation (17-18% in the heavy chains). mAbs in this family had more neutral pIs. Binding analyses indicated that the two members of this lineage bound Yu2 core+V3, but not the Yu2 core on Elisa (FIG. 5). Additionally, both mAbs bound the HIV-1 MN Complete V3 Loop Peptide on Elisa (FIG. 5), indicating that these mAbs recognize the V3 loop of HIV-1.

In a previous study of N60 (Sajadi et al., *J Infect Dis* 213, 156-164 (2016)), we determined that roughly 50% of the total anti-gp120 plasma response involved antibodies with λ light chains. As only Lineage 7 expressed λ light chains, it is evident that cross-reactive anti-V3 antibodies account for the bulk of the circulating anti-gp120 response in N60 (potentially up to 1% of the total circulating IgG). Such representation in the polyclonal anti-gp120 response is in accordance with the immunodominant nature of the V3 loop as evinced in studies of anti-gp120 responses in other cohorts (Javaherian et al., *Proc Natl Acad Sci USA* 86, 6768-6772 (1989); LaRosa et al., *Science* 249, 932-935 (1990); Vogel et al., *J Immunol* 153, 1895-1904 (1994)).

Preliminary screening of the mAbs for neutralizing activity against 15 tiers 1-3 pseudoviruses showed that Lineage 1 comprised the most broad and potent activity, followed by Lineages 2, 7, and 5 (Table 9).

TABLE 9 mAb screening ELISA and neutralization. For BaL-gp120 ELISA binding, background subtracted OD results shown for mAbs tested at 8 ug/ml. For HIV-1 neutralization, a neutralization was carried out against a panel of Tier 1-3 pseudoviruses (see Methods).

|  | mAb | Epitope | SF162.LS | BaL.26 | SS1196.1 | 6535.3 | QH0692.42 | SC422661.8 | PVO.4 | TRO.11 | AC10.0.29 |
|---|---|---|---|---|---|---|---|---|---|---|---|
| Lineage 1 | N60P1.1 | CD4-BS | 12.919 | >50 | 0.612 | 3.835 | 15.479 | 0.75 | 0.456 | 6.315 | >25 |
|  | N60P2.1 | CD4-BS | >50 | >50 | 1.836 | >25 | 2.995 | 12.690 | 1.683 | 19.597 | >25 |
|  | N60P25.1 | CD4-BS | 30.992 | >50 | 0.246 | 15.725 | 32.942 | 2.056 | 6.454 | 23.528 | >50 |
|  | N60P31.1 | CD4-BS | >50 | >50 | >50 | >50 | >50 | >50 | >50 | 1.807 | >50 |
| Lineage 2 | N60P22 | CD4-BS | 1.275 | 5.532 | 5.673 | 10.641 | 36.840 | >50 | >50 | >50 | >50 |
|  | N60P38 | CD4-BS | 5.765 | >50 | 7.979 | >50 | >50 | >50 | >50 | >50 | >50 |
| Lineage 3 | N60P30 | CD4i (ClusterA) | >50 | >50 | >50 | >50 | >50 | >50 | >50 | >50 | >50 |
| Lineage 4 | N60P36 | CoR-BS (ClusterC) | >50 | >50 | >50 | >50 | >50 | >50 | >50 | >50 | >50 |
| Lineage 5 | N60P39 | CoR-BS (ClusterC) | 3.189 | >50 | 4.611 | >50 | >50 | >50 | >50 | >50 | >50 |
|  | N6039.1 | CoR-BS (ClusterC) | 0.482 | 14.124 | 1.205 | >50 | 45.230 | >50 | >50 | >50 | >50 |
|  | N60P47 | CoR-BS (ClusterC) | 0.684 | 20.084 | 1.905 | >40 | >40 | >40 | >40 | >40 | >40 |
|  | N60P48 | CoR-BS (ClusterC) | 0.395 | 12.729 | .907 | >40 | 20.238 | >40 | >40 | >40 | >40 |
| Lineage 6 | N60P51 | CoR-BS (ClusterC) | .318 | 8.963 | 1.033 | >25 | >25 | >25 | >25 | >25 | >25 |
| Lineage 7 | N60P35 | V3 | .021 | 4.68 | 1.113 | >25 | >25 | >25 | >25 | >25 | >25 |
|  | N60P37 | V3 | 0.03 | 4.076 | .991 | >25 | >25 | >25 | >25 | | |

|  | mAb | Epitope | RHPA4259.7 | THRO4156.18 | REJO4541.67 | TRJO4551.58 | WITO4160.33 | CAAN5342.A2 |
|---|---|---|---|---|---|---|---|---|
| Lineage 1 | N60P1.1 | CD4-BS | 4.218 | >25 | 1.581 | 7.195 | >25 | 1.635 |
|  | N60P2.1 | CD4-BS | 15.684 | >25 | >25 | >25 | >25 | 6.733 |
|  | N60P25.1 | CD4-BS | 1.448 | >50 | 2.454 | >50 | >50 | 2.502 |
|  | N60P31.1 | CD4-BS | >50 | 31.038 | >50 | >50 | >50 | >50 |
| Lineage 2 | N60P22 | CD4-BS | >50 | 36.501 | >50 | >50 | >50 | >50 |
|  | N60P38 | CD4-BS | >50 | >50 | >50 | >50 | >50 | >50 |
| Lineage 3 | N60P30 | CD4i (ClusterA) | >50 | >50 | >50 | >50 | >50 | >50 |
| Lineage 4 | N60P36 | CoR-BS (ClusterC) | >50 | >50 | >50 | >50 | >50 | >50 |
| Lineage 5 | N60P39 | CoR-BS (ClusterC) | >50 | >50 | >50 | >50 | >50 | >50 |
|  | N6039.1 | CoR-BS (ClusterC) | >50 | >50 | >50 | >50 | >50 | >50 |
|  | N60P47 | CoR-BS (ClusterC) | >40 | >40 | >40 | >40 | >40 | >40 |
|  | N60P48 | CoR-BS (ClusterC) | >40 | >40 | >40 | >40 | >40 | >40 |
| Lineage 6 | N60P51 | CoR-BS (ClusterC) | >25 | >25 | >25 | >25 | >25 | >25 |

TABLE 9-continued mAb screening ELISA and neutralization. For BaL-gp120 ELISA binding, background subtracted OD results shown for mAbs tested at 8 ug/ml. For HIV-1 neutralization, a neutralization was carried out against a panel of Tier 1-3 pseudoviruses (see Methods).

| Lineage 7 | N60P35 | V3 | 3.733 | >25 | >25 | >25 | >25 | >25 |
|---|---|---|---|---|---|---|---|---|
| | N60P37 | V3 | 11.624 | >25 | >25 | >25 | >25 | >25 |

Figure 7:
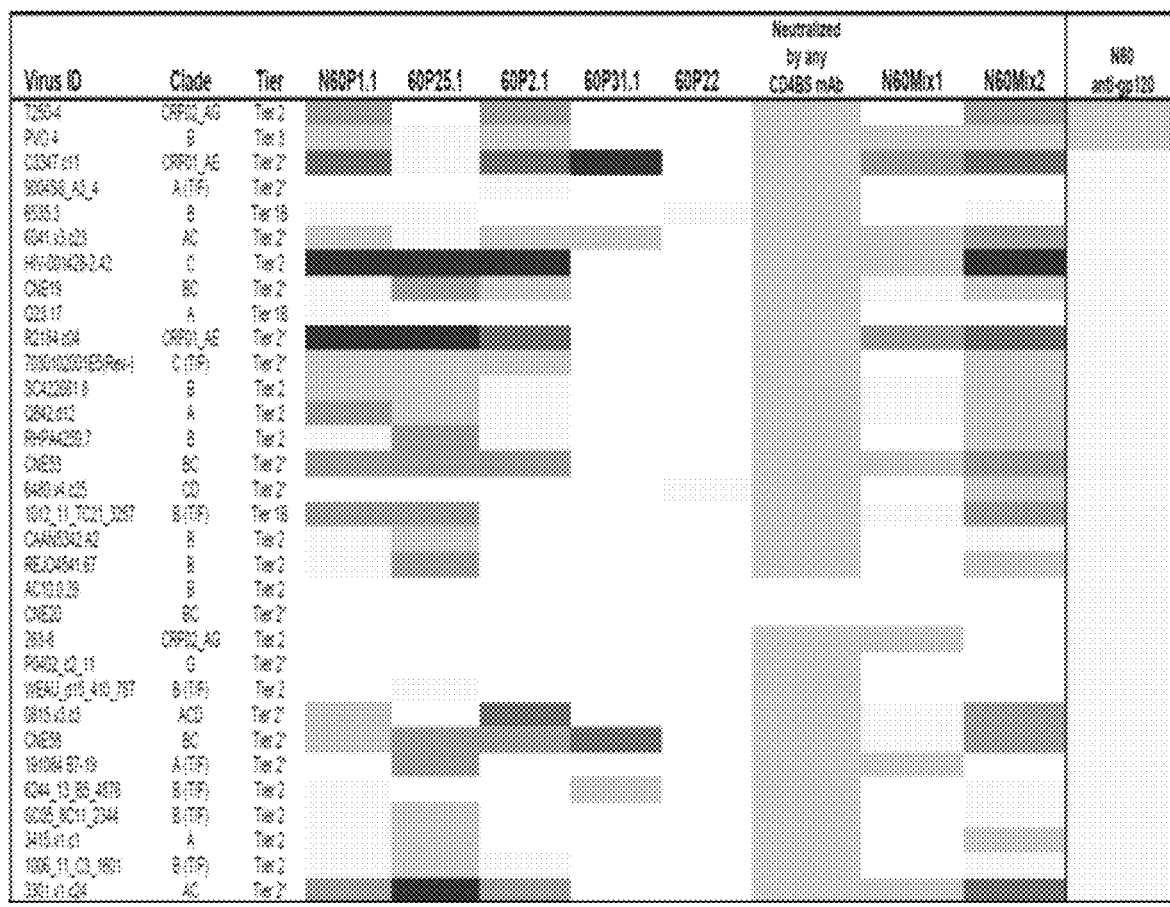
FIG. 7. Neutralization activity plasma derived anti-Env antibodies (alone and in combination). A panel of HIV-1 viral envelope strains (individual viruses listed on the left column) that were sensitive to the bulk plasma N60 gp120-Ig were tested against neutralizing anti-CD4-BS antibodies from Lineage 1 and 2. For Lineage 2, only one mAb N60P22 tested, as the other was a closely related clone (98% sequence homology). IC50 values are color-coded according to the color key on the left: the greater the neutralization, the darker red the color; grey represents no neutralization ($IC_{50}$>25 ug/ml). Taken together, the anti-CD4-BS mAbs neutralized 89% of the viruses that were sensitive to bulk plasma anti-gp120 Ig. An equimolar mix of the mAbs called N60mAb Mix1 (all CD4-BS, CD4i, and variable loop antibodies with >5% sequence divergence) were tested at equimolar concentrations neutralized 79% of the pseudoviruses, and N60mAb Mix2 (all CD4-BS antibodies with >5% sequence divergence at equimolar concentrations) neutralized 89% of the pseudoviruses. IC50=Inhibitory Concentration 50.
Figure 7:
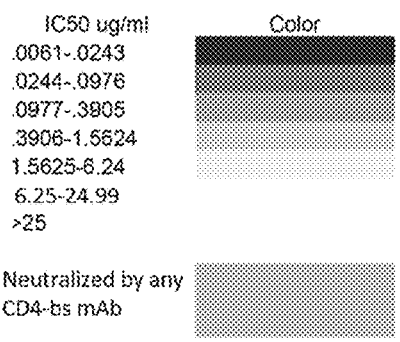
Figure 7:
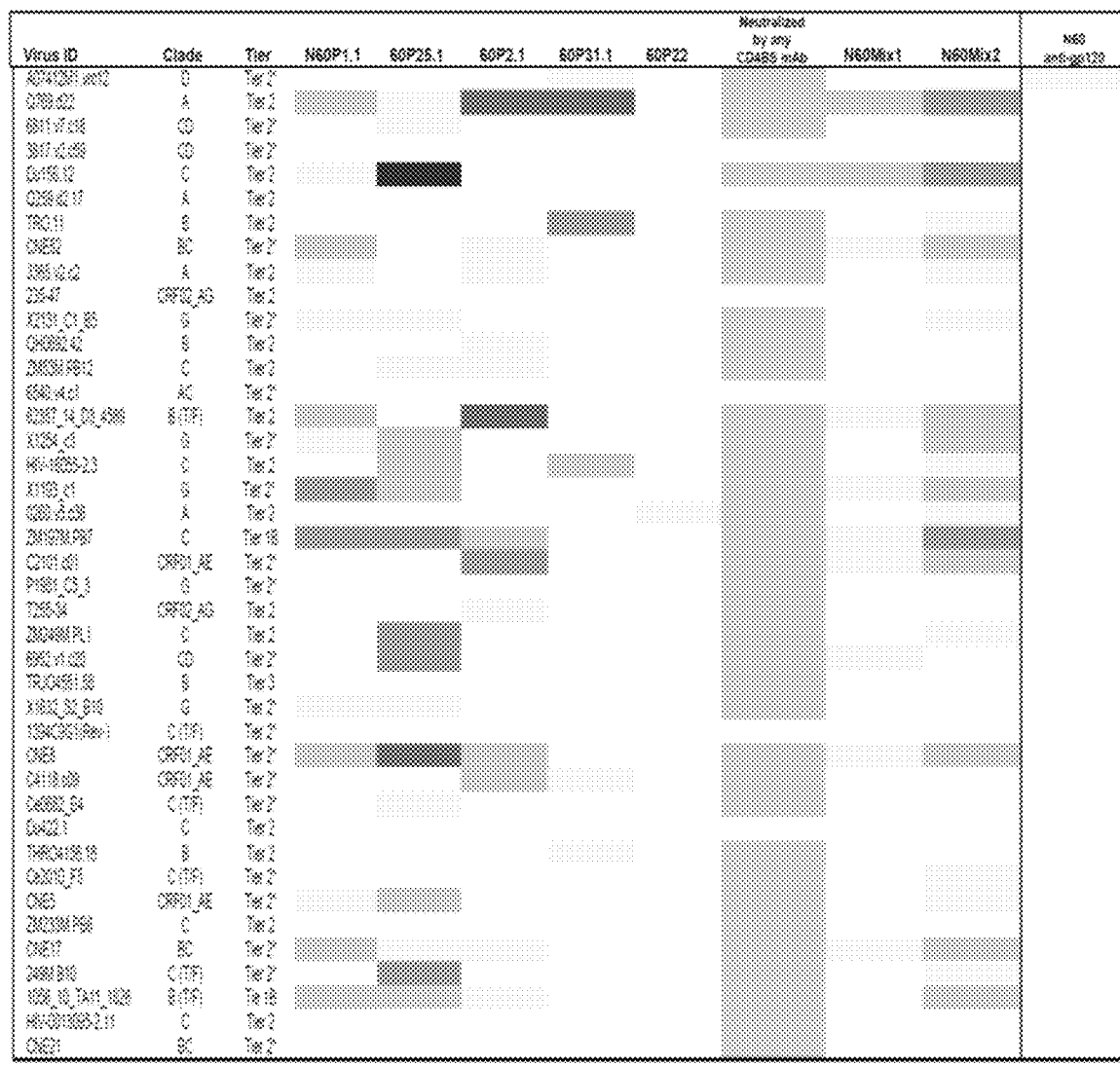

Expanded testing of Lineage 1 mAbs revealed neutralization breadth approaching the coverage observed with the polyclonal plasma anti-gp120 kappa Ig (FIG. 7). Two mAbs, N60P1.1 and N60P25.1, demonstrated particularly strong neutralizing activity (FIG. 7), matching 70% and 73% of the affinity purified plasma Ig breadth, respectively. Thus, broad plasma neutralizing activity in N60 appears to largely arise from Lineage 1, representing a monospecific fraction of the anti-gp120 repertoire at the time point evaluated. Anti-CD4BS mAbs from Lineage 2, which appeared in high frequency but did not have strong breadth and potency, contributed minimally to the overall plasma profile. In any case, the concurrence of other types of poorly neutralizing anti-gp120 antibodies does not appear to abrogate the presence and activity of broadly neutralizing antibodies in circulation.

Despite their breadth and potency, none of the anti-CD4BS mAbs from Lineage 1 matched the full breadth of the polyclonal plasma anti-gp120 Ig recovered from N60. Considered collectively, the anti-CD4BS mAbs neutralized 89% of the viruses that were sensitive to bulk anti-gp120 plasma Ig. Resistance to the mAbs was independent of virus clade or Tier (FIG. 7). Notably, one resistant pseudovirus was neutralized by the Lineage 5 anti-CD4i mAb, N60P39. Thus, the combined profiles of six mAbs including N60P39 could cover 90% of the viruses neutralized by bulk anti-gp120 plasma Ig. To determine if greater breadth could be established by mAb mixtures, the panel of viruses sensitive to bulk anti-gp120 plasma Ig were tested against an equimolar pool of all anti-CD4 BS mAbs, or an equimolar combination of represented mAbs from all lineages (related clones with <5% amino acid sequence diversity were not included). These mAb pools covered, respectively, 89 and 79% of the neutralizing activity breadth mediated by the plasma Ig (FIG. 7). These results suggest that the plasma neutralizing response in N60 could involve a cryptic anti-gp120 specificity (active against a small subset of test viruses resistant to the identified mAbs) and/or a molar ratio of specificities that we could not readily duplicate in vitro.

Previously we reported that multiple Clade B HIV infected patients expressed broadly neutralizing plasma antibody responses with similar biochemical characteristics (Sajadi et al., *J Acquir Immune Defic Syndr* 57, 9-15 (2011); Sajadi et al., *J Infect Dis* 213, 156-164 (2016).

Figure 8:
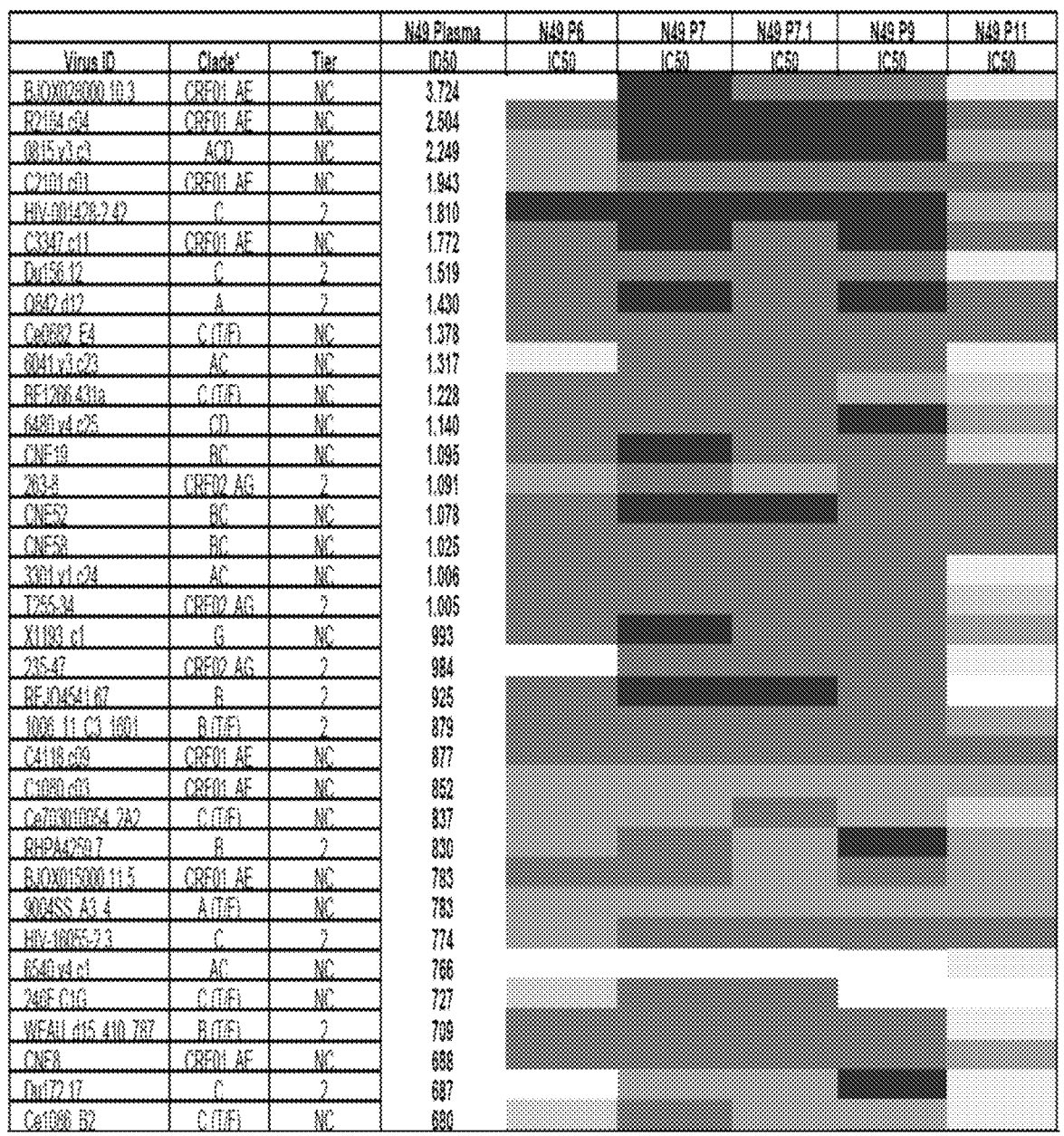
FIG. 8. Neutralization activity of NVS49 plasma and P series mAbs. A panel of HIV-1 viral envelope strains (individual viruses listed on the left column) were tested against all N49 plasma and CD4-BS antibodies. IC50 values are color-coded according to the color key on the left: the greater the neutralization, the darker red the color; white represents no neutralization ($IC_{50}$>50 ug/ml). The individual mAbs showed extreme breadth with N49P6, N49P7, and N49P11 exhibiting 100% breadth, N49P7.1 exhibiting 99% breadth, and N49P9 exhibiting 89% breadth. IC50=Inhibitory Concentration 50.
Figure 8:
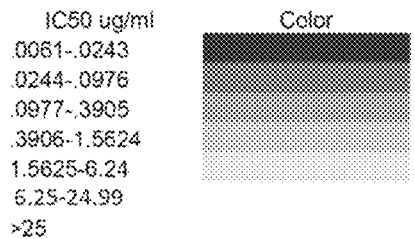
Figure 8:
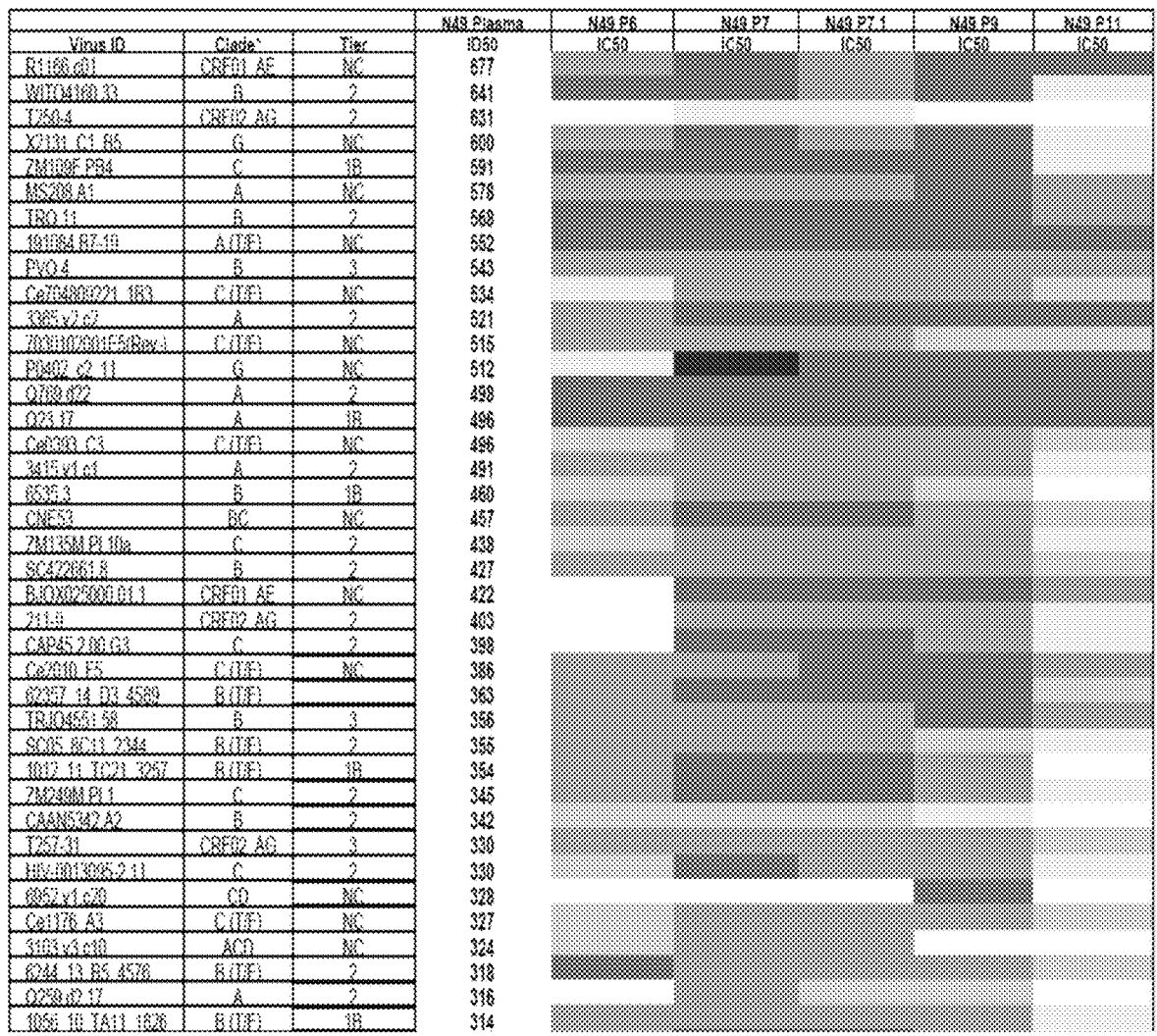
Figure 8:
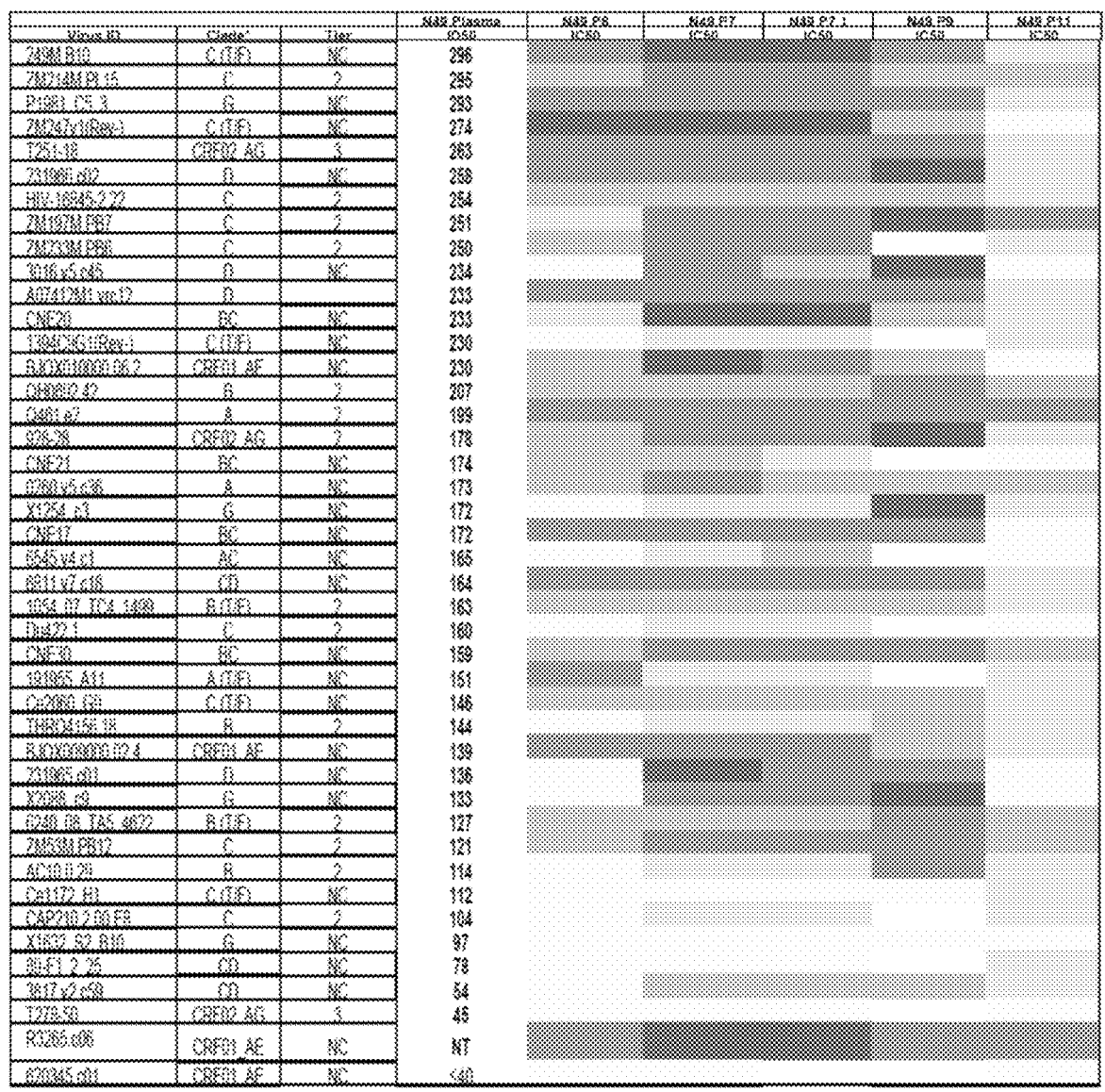
Figure 8:
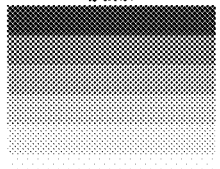

Sajadi et al., *J Virol* 86, 5014-5025 (2012)), such as basic pIs. We posited that this trend reflected shared inter-subject specificity for neutralizing gp120 epitopes. To test this hypothesis, we applied the same deconvolution procedures and selection algorithms described above to another NVS cohort subject, N49, who exhibited a very broad neutralization response against 99% of a 117 virus panel (FIG. 8). Similar to the N60 responses, the neutralizing antibodies from N49 plasma could be recovered from plasma by gp120 affinity chromatography (recovered gp120 affinity fraction known to be approximately 1% of the starting mass of IgG antibody for this patient); however, in this case the λ fraction contained the broad neutralizing antibodies.

Figure 9:
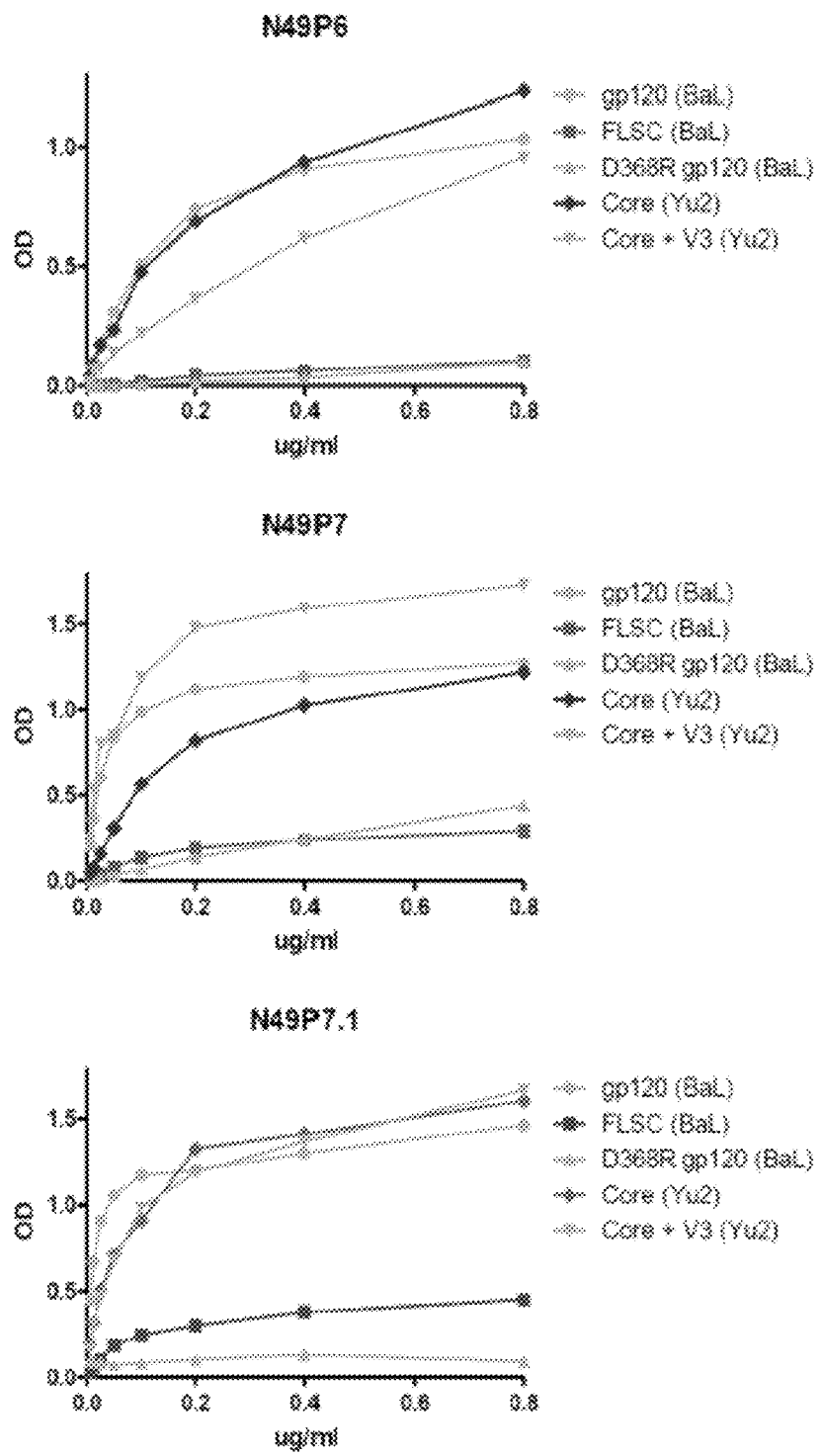
FIG. 9. ELISA Reactivity of the N49 P series mAbs. Dilutions of each mAb was tested by ELISA for reactivity against the indicated HIV antigens: BaL-gp120 monomer, BaL-gp120 monomer with the D368R mutation to abrogate CD4-BS binding, Yu2 gp120 core, Yu2 gp120 core+V3, and full length single chain (FLSC), presenting a full length CD4-induced gp120 structure in which the CD4-BS is occupied. X-axis shows mAb concentration in ug/ml, and Y axis the background-subtracted OD.
Figure 9:
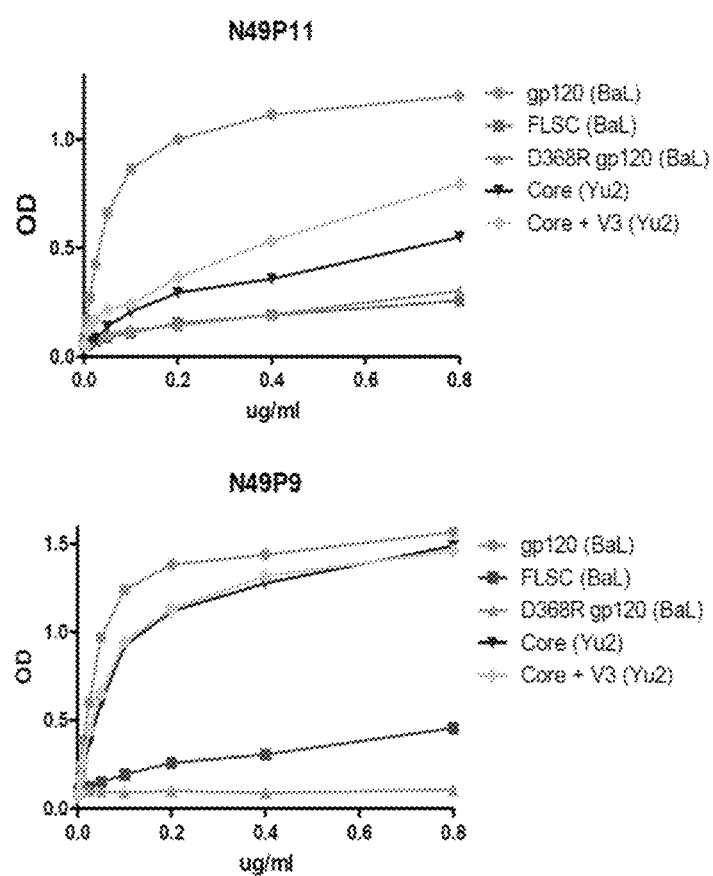
Figure 10:
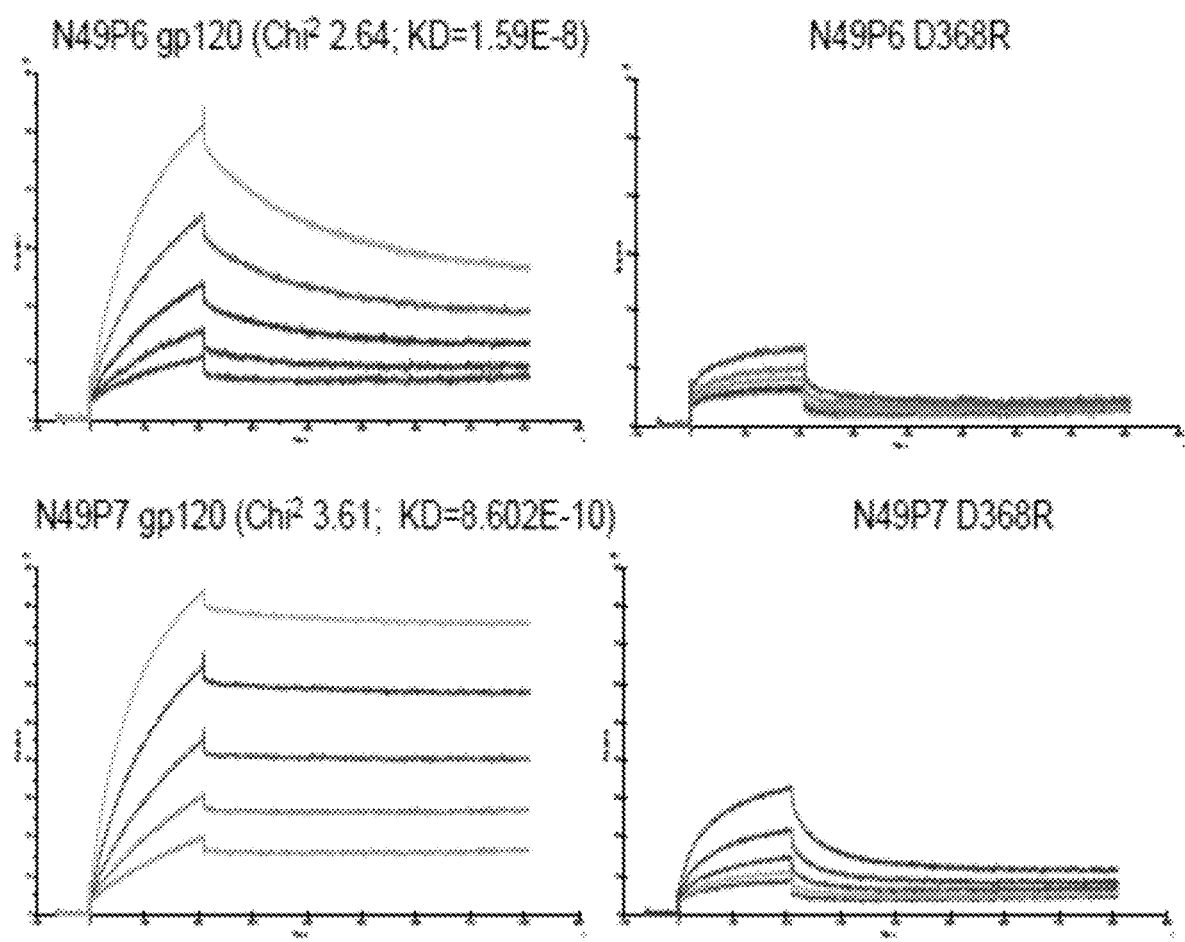
FIG. 10. Surface plasmon resonance analysis of N49 P series mAbs to HIV-1 envelope antigens. The binding kinetics for BaL-gp120 or D368R with mAb captured on Protein A-coated chips are shown. Data sets with significant dose response were globally fit to a 1:1 binding model to obtain the kinetic parameters of the binding. All mAbs tested bound strongly to gp120 monomer but exhibited weak binding to D368R.
Figure 10:
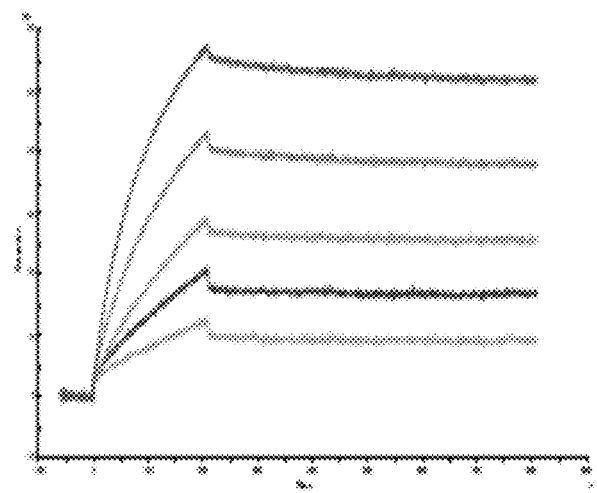
Figure 10:
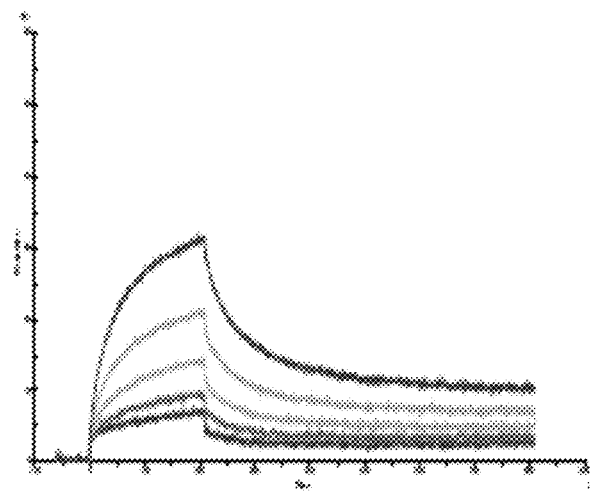
Figure 10:
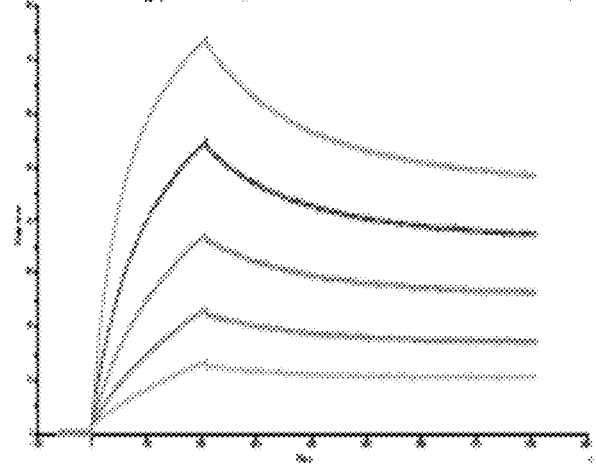
Figure 10:
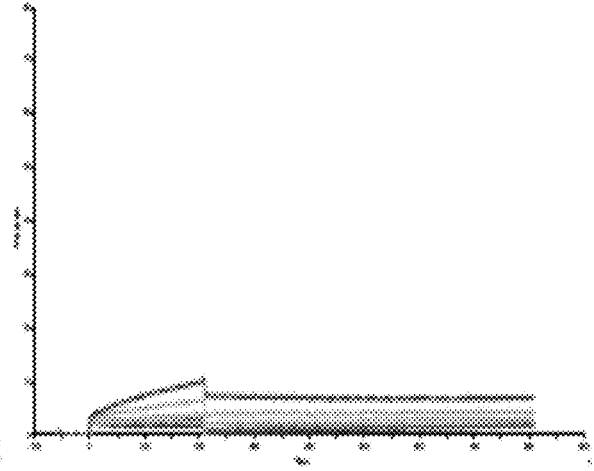
Figure 10:
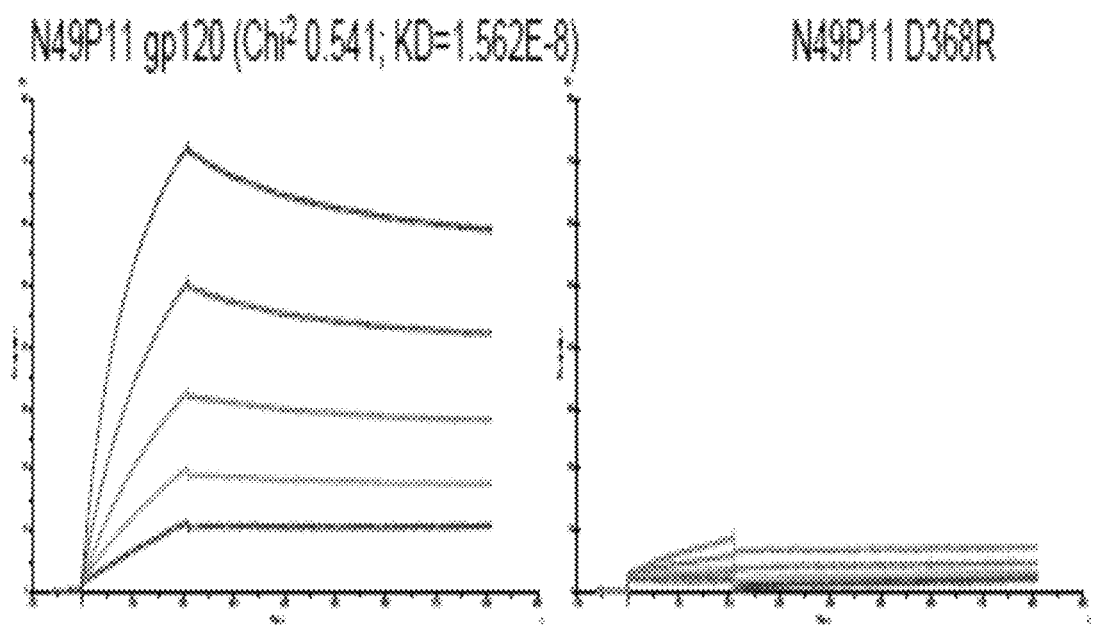

The broadly neutralizing antibodies in N49 plasma fell into two lineages, distinguished by different light chain gene usage (Table 10). Similar to the N60 Lineage 1 broadly neutralizing antibodies, the N49 mAbs all exhibited basic pIs and VH1-2 gene usage. However, all of the N49 mAbs used λ light chain genes, while also containing a CDRL3 deletion. The binding characteristics of this N49 lineage also matched the N60 neutralizing antibodies, reflecting anti-CD4BS specificity. These antibodies bind to monomeric gp120, have little to no binding to D368R and FLSC in both Elisa and biacore (FIGS. 9 and 10).

TABLE 10

Properties of mAbs engineered from NVS49.

| | | | | | | Frequency of CDR3 (per 1000) | | |
|---|---|---|---|---|---|---|---|---|
| mAb | Epitope | Heavy pI chain | Light chain | Lambda Constant | Heavy mutation | Peripheral plasmablast | Bone marrow 138− | Bone marrow 138+ |
| N49P6 | CD4-BS | 8.9 1-2 | 2-11 | LC7 | 42%/28% | 0 | 0 | 0.49 |
| N49P7 | CD4-BS | 8.8 1-2 | 2-11 | LC2 | 38%/31% | 0 | 0 | 0.49 |
| N49P7.1 | CD4-BS | 8.8 1-2 | 2-11 | LC2 | 38%/31% | 0 | 0 | 0.49 |
| N49P11 | CD4-BS | 8.4 1-2 | 2-11 | LC2 | 35%/30% | 3.18 | 0 | 0 |
| N49P9 | CD4-BS | 8.7 1-2 | 2-23 | LC7 | 38%/42% | 3.18 | 0 | 0.49 | mAb = monoclonal antibody.
VDJ = Variable Diversity Junction.
LC = Lambda constant.
AA = amino acid.
Mutation = somatic hypermutation given as a percent of germline V region for heavy chains, and VJ region for light chains.
NT = not tested A distinguishing feature of the N49 anti-CD4BS mAbs was that they exhibited remarkably broad neutralizing activity when tested against a multi-clade, tier 1-3 panel of 117 pseudoviruses. As shown in FIG. 8, N49 mAbs N49P6, N49P7, and N49P11 individually neutralized 100% of the viruses. The N49 P series mAbs also had high potency, with ability to neutralize 41.5-86.4% of all viruses at under 1 ug/ml. MAb N49 P7 had complete breadth (ability to neutralize all 117 pseudoviruses) and the highest potency (86.4%). The breadth and potency of the N49 group of mAbs was compared other mAbs reported to have substantial breadth (PGT121, PGT128, PGT145, PGDM1400, PGT151,10-1074,10E8, PG9, PG16, 3BNC117, NIH45-46, 8ANC195, VRC07, and VRC01), using the same neutralization assay and panel. The breadth of the N49 mAbs surpassed those of all mAbs tested (Table 11). Although, we did not test another recently reported broad neutralizing antibody against the CD4BS, N6 (Williams et al., *Science Immunology* 2, (2017)), four of the N49 mAbs could neutralize T278-50, which is N6 is resistant to. N49 was fundamentally distinguished from N60 in the sense that three identified plasma mAbs (N49P6, N49P7, and N49P11) completely recapitulated the antiviral breadth of affinity purified anti-gp120 plasma IgG.

TABLE 11

Comparison of neutralization breadth between those derived from NVS49 and those in the literature. Percentages are given as values of viruses neutralized (IC50 < 50 ug/ml)/viruses tested. All testing was done in the same lab. N49 P series tested against the full 117 virus panel. All other mAbs tested against 114-117 pseudoviruses, except for VRC01, which was tested against 96. Neutralization at titers >50 µg/mL were considered non-neutralizing.

| mAb | % neutralization |
| --- | --- |
| N49P6 | 100% |
| N49P7 | 100% |
| N49P7.1 | 99% |
| N49P11 | 100% |
| N49P9 | 89% |
| PGT121 | 65.8% |
| PGT128 | 59.8% |
| PGT145 | 74% |
| PGDM1400 | 79.8% |
| PGT151 | 65.5% |
| 10-1074 | 56.8% |
| 10E8 | 94.9% |
| PG9 | 84.7% |
| PG16 | 82.2% |
| 3BNC117 | 90% |
| NIH 45-46 | 86.4% |
| 8ANC195 | 65.2% |
| VRC07 | 91.5% |
| VRC01 | 87.6% |

Materials and Methods

Patients. The patients identified for this study was selected from the NVS study (Sajadi et al., *J Acquir Immune Defic Syndr* 57, 9-15 (2011); Sajadi et al., *J Acquir Immune Defic Syndr* 50, 403-408 (2009); Sajadi et al., *AIDS* 21, 517-519 (2007)). NVS patients are defined as having HIV-1 by Western Blot while having an HIV-1 RNA<400 copies/ml for at least 4 measurements and 2 years. N60 met the above definition, while N49 had a higher viral load setpoint, averaging 7,854 HIV-1 copies/ml over 9 years. Both of the patients' serum were identified as having broad neutralizing activity based on Tier 2 activity and a cross-clade neutralization panel (Sajadi et al., *J Acquir Immune Defic Syndr* 57, 9-15 (2011); Sajadi et al., *J Infect Dis* 213, 156-164 (2016); Sajadi et al., *J Virol* 86, 5014-5025 (2012).

Proteins and Antigens. Recombinant HIV-1 antigens were generated as described previously (31). Test antigens included the YU2 gp120 core, from which V1, V2, and V3 have been deleted (Wu et al., *Nature* 384, 179-183 (1996)); the YU2 gp120 core containing the V3 loop (YU2 gp120 core+V3) (Wu et al., *Nature* 384, 179-183 (1996)); monomeric HIV-1 Ba-L gp120 (Fouts et al., *J Virol* 74, 111427-111436 (2000)); D368R Ba-L gp120, which has a single point mutation at position 387 (Li et al., *Nat Med* 13, 1032-1034 (2007)); and a single chain gp120-CD4 complex (FLSC) presenting a full length CD4-induced Ba-Lgp120 structure in which the CD4 binding site is occupied (Fouts et al., *J Virol* 74, 111427-111436 (2000)). Two monoclonals specific for the C-terminal peptide of HIV-1 gp120 were sued: an affinity-purified goat Ab, D7324, purchased from Cliniqa (San Marcos, CA) and JR52 a mouse monoclonal. All proteins were expressed by transient transfection of 293T cells as previously describe and purified by lectin affinity chromatography as previously described and dialyzed against PBS prior to use (Fouts et al., *J Virol* 74, 111427-111436 (2000)). The following reagent was obtained through the NIH AIDS Reagent Program, AIDS Program, NIAID, NIH: HIV-1 V3 Peptides from the Division of AIDS, NIAID.

Isolation of plasma antibody species. Whole plasma IgG was purified on a Protein A or Protein A/G affinity chromatography column (GE Healthcare, Piscataway, NJ) according to the manufacturer's instructions and dialyzed against PBS prior to use. Affinity chromatography columns were made with activated CH Sepharose beads (GE Healthcare, Piscataway, NJ) coupled to 2 mg of recombinant HIV-1 Ba-L gp120 (Fouts et al., *J Virol* 74, 111427-111436 (2000)), as described previously (Guan et al., *Proc Natl Acad Sci USA* 106, 3952-3957 (2009)). Beads specific for human IgG1, human κ chain, and human λ chain were purchased from Capture Select (Naarden, Netherlands). The columns were used to purify antigen-specific IgG (anti-gp120), fractionate IgG1 from whole IgG, or fractionate IgG into κ and λ fractions, as previously described (Sajadi et al., *J Acquir Immune Defic Syndr* 57, 9-15 (2011); Guan et al., *Proc Natl Acad Sci USA* 106, 3952-3957 (2009). Briefly, IgG was incubated with beads at 37° C. for one hour prior to extensive washing with PBS. Columns were eluted at room temperature with pH 2.8 0.2M glycine (for elution of κ antibodies pH 2.0 was used) and dialyzed against 4 liters PBS 3 times (a minimum of 24 hours total) prior to testing. Dedicated columns were used for each subject and antigen. IgG concentration was measured using an in-house quantitative ELISA as previously described (Guan et al., *Proc Natl Acad Sci USA* 106, 3952-3957 (2009)). After a series of steps, the plasma was fractionated into IgG1 κ and IgG1 λ antibodies (plasma→protein A column→IgG1 column→kappa and lambda columns), anti-gp120 κ and anti-gp120 λ antibodies (plasma→protein A column→gp120 column→kappa and lambda columns), or anti-gp120 antibodies (plasma→protein A column→gp120 column).

Affinity purified and fractioned antibody was subjected to free flow electrophoresis on the BD Free Flow Electrophoresis System (BD, Franklin Lakes, NJ). The separation, stabilization and counter flow media was freshly prepared according to instructions of the manufacturer. The separation and counter flow media contained 0.2% hydroxypropyl methylcellulose (HPMC). The pH range of separation media was 0.88 to 12.8. The media flow rate in the separation chamber was 41 mL/hour. The antibodies (200 to 350 µg/ml) were introduced to separation chamber at the rate of 560 µl/h in the electrical field of 2300V/10 mA/24 W. IEF fractionated samples collected in a 96 deep-well polystyrene microtiter plate, with each well containing 1-2 ml. Approximately half of these wells contained antibody fractionated based on PI. Fractionation was confirmed with pH reading of individual fractions (FIG. 1), as well as an IEF gel. Separately, affinity purified antibody fractions (prior to FFE) were also run on IEF gels.

Neutralization assay. HIV-1 neutralization testing was performed using a luciferase-based assay in TZM.b1 cells as previously described (Sajadi et al., *J Acquir Immune Defic Syndr* 57, 9-15 (2011); Li et al., *J Virol* 79, 10108-10125 (2005)). This assay measures the reduction in luciferase expression following a single round of virus infection. Stocks of Env-pseudotyped viruses were prepared by transfection of 293T/17 cells as previously described (Li et al., *J Virol* 79, 10108-10125 (2005)). Unfractioned serum samples, affinity purified antibody, fractionated affinity purified IgG samples, and mAbs were tested against MuLV control and a panel of psuedoviruses. Three-fold serial dilutions of IgG were tested in duplicate (96-well flat bottom plate) in 10% D-MEM growth medium (100 ul/well). 200 TCID50 of pseudovirus was added to each well in a volume of 50 ul and the plates were incubated for 1 hour at 37° C. TZM.b1 cells were then added ($1 \times 10^4$/well in 100 ul volume) in 10% D-MEM growth medium containing DEAE-Dextran (Sigma, St. Louis, MO) at a final concentration of 11 ug/ml. The final volume for each well was 250 ul. Assay controls included replicate wells of TZM.b1 cells alone (cell control), TZM.b1 cells with virus (virus control), and MuLV control. Following a 48 hour incubation at 37° C., 150 ul of assay medium was removed from each well and 100 ul of Bright-Glo luciferase reagent (Promega, Madison, WI) was added. The cells were allowed to lyse for 2 minutes, then 150 ul of the cell lysate was transferred to a 96-well black solid plate and luminescence was measured using a Victor 3 luminometer (Perkin Elmer, Waltham, MA). The 50% inhibitory concentration (IC50) and 80% inhibitory concentration (IC80) titers were calculated as the immunoglobulin concentration that caused a 50% or 80% reduction in relative luminescence units (RLU) compared to the virus control wells after subtraction of cell control RLUs (Li et al., *J Virol* 79, 10108-10125 (2005)).

ELISA. HIV-1 envelope capture ELISAs were performed as previously described (Guan et al., *Proc Natl Acad Sci USA* 106, 3952-3957 (2009)) with various antigens (as indicated in the text) that were directly coated (HIV-1 Ba-L SOSIP trimer, 1 ug/ml; YU2 gp120 core construct and YU2 gp120 core plus V3; 2 ug/ml) or captured (Bal-gp120 or FLSC at a concentration of 0.15 ug/ml) by antibody D7324 or JR52 that had been adsorbed to the solid phase at 2 ug/ml. For IEF-fractionated affinity purified IgG, 5 ng from each fraction was tested in a total assay volume of 50 ul. All IgG preparations were incubated with antigens for 1 hour at 37° C. Bound Abs were then detected with 1:1,000-diluted alkaline phosphatase (AP)-goat antihuman IgG (Southern Biotech; Birmingham, AL) and detected with Blue Phos Microwell Phosphatase Substrate System (KPL, Gaithersburg, MD). All assays were performed in duplicate or repeated several times. Negative control assays were carried out with secondary antibody; background values were subtracted from all test absorbance readings.

Isolation of Plasma mAbs. Antibody species that were isolated to individual fractions were subjected to LC-MS (in addition to FFE fractions, several experiments were carried out with affinity purified fractions or cut-out IEF bands from an IEF gel). Antibody was digested with trypsin, chymotrypsin, or Glu-C overnight at 37° C., the peptides evaporated to 15 ul. The LC-MS system consisted of a Thermo Electron Orbitrap Velow ETD mass spectrometer with a Protana nanospray ion source interfaced with a Phenomenex Jupiter C18 reversed-phase capillary column. The peptide digest was fragmented with both CID and HCD. LC-MS was performed at the University of Maryland School of Pharmacy and Northwestern Proteomics Center of Excellence, none of which were involved in the data analysis. The spectra were searched with Peaks software (Bioinformatics Solutions Inc, Ontario, CA) against multiple B cell databases generated from the patient described below.

Single cell sorting. Single-cell sorting and sequencing was done at Atreca (Redwood City, CA) on PBMC memory B cells (Yu2-gp140 reactive), PBMC plasmablasts, and bone marrow plasma cells and patient-specific B cell databases generated. All paired chain antibody sequencing was carried out on IgG cells sorted into microtiter plates at one cell per well by FACS. IgG plasmablasts were enriched from cryopreserved peripheral blood mononuclear cells (PBMCs) by gating for CD3-CD14-CD16-CD19+CD20-CD27+CD38$^{hi}$IgA-IgM-IgD-cells. Antigen-specific cells were isolated from PBMCs using fluorescently-labeled YU2 gp140 (43) and cultured for 4 days prior to single cell sorting in IMDM medium (Invitrogen) in the presence of FBS, Pen/Strep, IL-2 (PeproTech), IL-21 (PeproTech), and rCD40 ligand (R&D Systems). In some experiments, the bone marrow plasma cells (CD3-CD14-CD16-CD38$^{hi}$IgA-IgM-IgD-) were further sorted and analyzed based on CD19 and CD138.

Paired chain antibody sequencing. Generation of barcoded cDNA, PCR ampification, and 454 sequencing of IgG were performed as described in Tan et al. 2014, with the following modifications: biotinylated Oligo(dT) and RT maxima H– (Fisher Scientific Company) were used for reverse transcription, cDNA was extracted using Streptavidin C1 beads (Life Technologies), DNA concentrations were determined using qPCR (KAPA SYBR® FAST qPCR Kit for Titanium, Kapabiosystems), and amplicons were sequenced using Roche 454 Titanium sequencing.

Barcode assignment, sequence assembly, assignment of V(D)J and identification of mutations. These steps were performed as previously described (Tan et al., *Clin Immunol* 151, 55-65 (2014)), except for the following: a minimum coverage of 10 reads was required for each heavy and light chain assembly to be acceptable. Wells with more than one contig for a chain were rejected from consideration unless one of the contigs included at least 90% of the reads. V(D)J assignment and mutation identification was performed using a variant of SoDA (Volpe et al., *Bioinformatics* 22, 438-444 (2006)). Antibody amino acid sequences were aligned to heavy and light chain hidden Markov models using hmmalign. The resulting multiple sequence alignments were used to generate a neighbor-joining tree with RapidNJ (Simonsen M, Pedersen CNS, in *WABI* 2008, L. J. Crandall KA, Ed. (Springer, Heidelberg, 2008), vol. 5251, pp. 113-122).

Mass spectrometry analysis and generation of plasma antibodies. Antibody species that were isolated to individual fractions were subjected to LC-MS (in addition to FFE fractions, several experiments were carried out with affinity purified fractions or cut-out IEF bands from an IEF gel). Antibody was digested with trypsin, chymotrypsin, or Glu-C overnight at 37° C., the peptides evaporated to 150. The LC-MS system consisted of a Thermo Electron Orbitrap Velow ETD mass spectrometer with a Protana nanospray ion source interfaced with a Phenomenex Jupiter C18 reversed-phase capillary column. The peptide digest was fragmented with both CID and HCD. LC-MS was performed at the University of Maryland School of Pharmacy and Northwestern Proteomics Center of Excellence, none of which were involved in the data analysis. The spectra were searched with Peaks software (Bioinformatics Solutions Inc., Ontario, CA) against multiple B cell databases generated from the patient described above.

An array of whole IgG H and L amino acid sequences were translated from the database and used as a basis for interpreting the peptide data. The LC-MS derived spectra were searched against the databases independently using the following settings: Parent Mass Error Tolerance 5.0 ppm, Fragment Mass Error Tolerance 0.5 Da, Fixed modification of Carboxymethyl (58.01), False Discovery Rate for peptides 5%. Potential antibodies were ranked based on number of unique peptides in the heavy and light chain sequences (≥4 unique peptides and 50% coverage in at least one of the H and L chain of each pair or with ≥4 unique peptides required in each H and L chain for the combined fractions). The identified VH or VL region clones were cloned into an expression vector upstream to human IgG1 constant domain sequence. Minipreps of these DNA pools, derived from suspension bacterial cultures, were used to transiently transfect 293 Freestyle cells. Transfectant supernatants containing recombinant antibodies were screened in ELISA and neutralization assays.

One caveat of the alignment algorithm is that certain peptides (typically from framework regions) can redundantly align with multiple Ig H and L template pairs, thus creating random peptide assemblages. This caveat was mitigated by rank ordering the Ig H and L templates according to the number of "unique" peptide alignments (i.e. not matching any other Ig sequence in the database; see Methods for details) they comprised. False discovery rates were held at 5% to further increase the probability that peptide sequences were properly grouped and aligned within a full-length Ig sequence. It was also important to consider that similar degrees of total template "coverage" by plasma amino acid sequences could differ substantially in the numbers of unique peptide alignments.

In the primary approach, FFE fractions of affinity-isolated anti-gp120 plasma antibodies were evaluated individually to score and select corresponding H and L template pairs. This identified 8 paired H and L Ig genes encoding plasma mAbs N60P1.1, N60P22, N6025.1, N60P36, N60P38, N60P39.1, N60P35, and N60P37. A second approach applied the bulk polyclonal anti-gp120 antibodies to preparative isoelectric focusing (IEF) gels. Immunoglobulins were extracted from sequential slices of the gels and digested to obtain peptide sequences, which were then compared against the patient-specific Ig gene database. This operation identified all but one of the H and L sequence pairs found in the primary approach as well as 4 additional ones: N60P2.1, N60P30, N60P31.1, N60P48.1, and N60P51. A third approach generated peptides and their corresponding sequences directly from affinity-enriched anti-gp120 plasma antibodies and combining this information with the gel digests from the second approach. This exercise mitigated the risk that sequences were overlooked in the other methods due to protein loss but required combining 27 separate digests. Even so, this approach identified most of the same H and L sequence pairs found by the other approaches (missing 2 but identifying 1 additional mAb-N60P39. We identified one additional mAb that was not picked up with the above methods by a homology search of the bone marrow database. This mAb (N60P47) had no binding to gp120 on Elisa, and thus had either no binding to gp120, as in the case of antibodies targeted at the hybrid epitope of CD4 and gp120, or bound to gp120 so weakly that too little was recovered to identify correctly.

Example 2. Broadly Neutralizing HIV Antibodies

Using a method for isolating monoclonal antibodies that match the circulating antibodies in circulation, we have isolated a series of broadly neutralizing antibodies against HIV-1. The subject these antibodies were isolated from (NVS49, also referred to as Subject 8 in previous publications) has extremely potent antibodies against HIV-1 (Sajadi et al., *J Acquir Immune Defic Syndr* 57, 9-15 (2011); Sajadi et al., *J Virol* 86, 5014-5025 (2012); Sajadi et al., *J Infect Dis* 213, 156-164 (2016)). At the point of testing, the patient had HIV for at least 21 years. The patient's plasma was the time point closest to when the antibodies were derived from was able to neutralize 99% of HIV strains from around the world (Excel file "N49 neutralization and sequences"), including strains that other HIV mAbs that are undergoing clinical testing are resistant to.

We have been able to isolate 2 distinct families of antibodies from this patient. All of these antibodies have been engineered with the same IgG1 heavy chain backbone (not obtained from patient NVS49 and in fact found in a different racial group), along with VDJ sequences obtained from patient NVS49. In addition, various clones have mutations in the VDJ or constant regions, and some antibodies have swapped Lambda constant regions.

Figure 11:
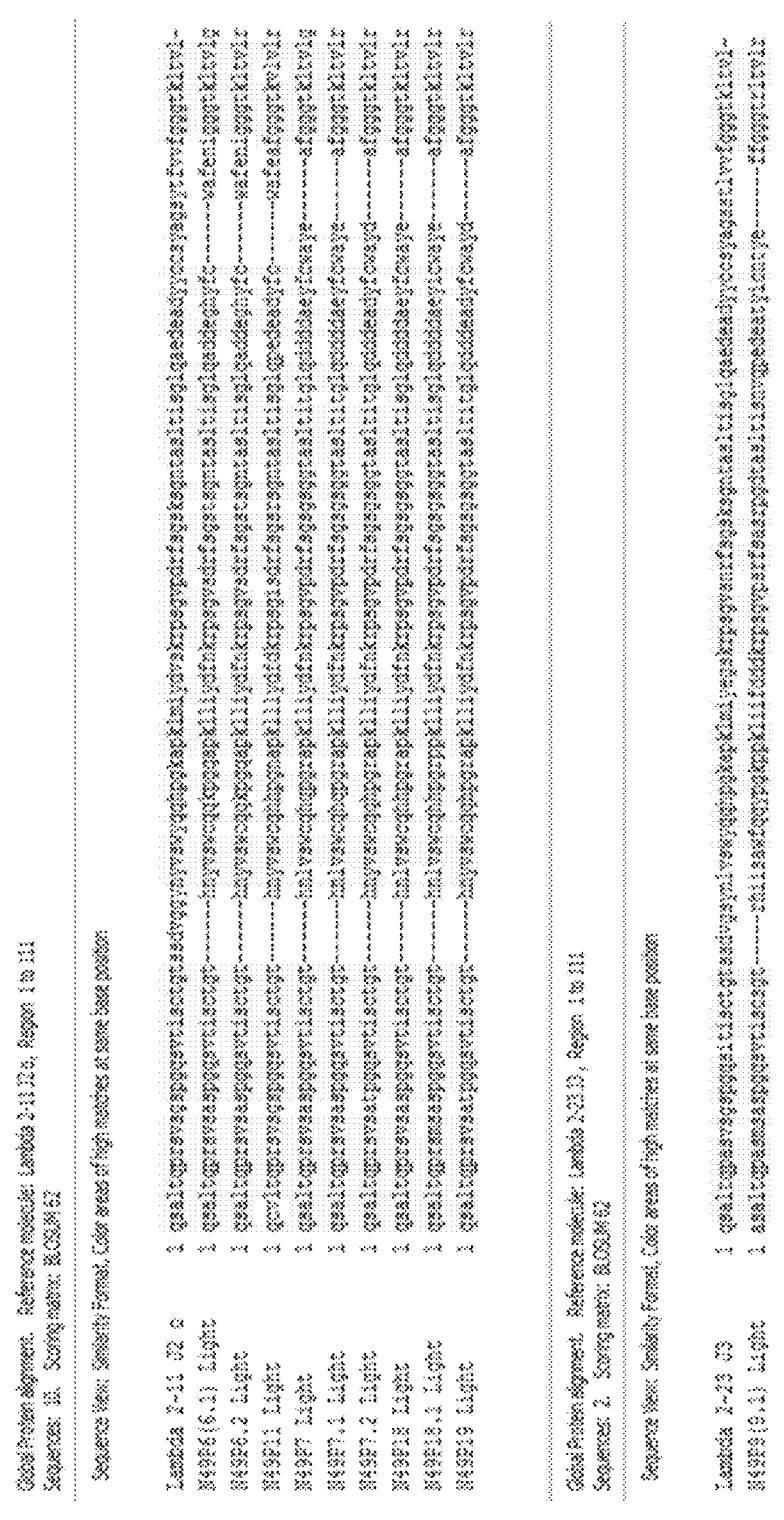

The first family comprises of N49P6, N49P7, N49P11, N49P18 and their various clones (N49P6.1, N49P6.2, N40P7.1, N49P7.2, N49P11.1, N49P18.1). The second family comprises of N49P9 and its clone N49P9.1. Both family of antibodies use the 1-2 Heavy chain family, while using 2 different Lambda light chain gene families (Lambda 2-11 and Lambda 2-23) (see Table 12 and FIG. 11 for more details).

TABLE 12

Properties of mAbs engineered from NVS49.

| mAb | Heavy chain | Light chain | Lambda Constant | Heavy mutation | Light mutation | pI | Notes |
|---|---|---|---|---|---|---|---|
| N49P6 | 1-2 | 2-11 | LC7 | 42% | 28% | 8.9 | |
| N49P6.1 | 1-2 | 2-11 | LC7 | 42% | 28% | 9.0 | VDJ identical to N49P6<br>Heavy constant: 1 AA difference with N49P6 |
| N49P6.2 | 1-2 | 2-11 | LC2 | 42% | 28% | 9.0 | VDJ identical to N49P6<br>Heavy constant: Same as N49P6.1<br>Lambda constant: 1 AA difference with N49P6/6.1, also LC2 not LC7 |
| N49P7 | 1-2 | 2-11 | LC2 | 38% | 31% | 8.8 | |
| N49P7.1 | 1-2 | 2-11 | LC2 | 38% | 31% | 8.8 | VDJ identical to N49P7<br>Heavy constant: 1AA difference with N49P7<br>Lambda constant: 1AA difference with N49P7 |

TABLE 12-continued

Properties of mAbs engineered from NVS49.

Figure 12:
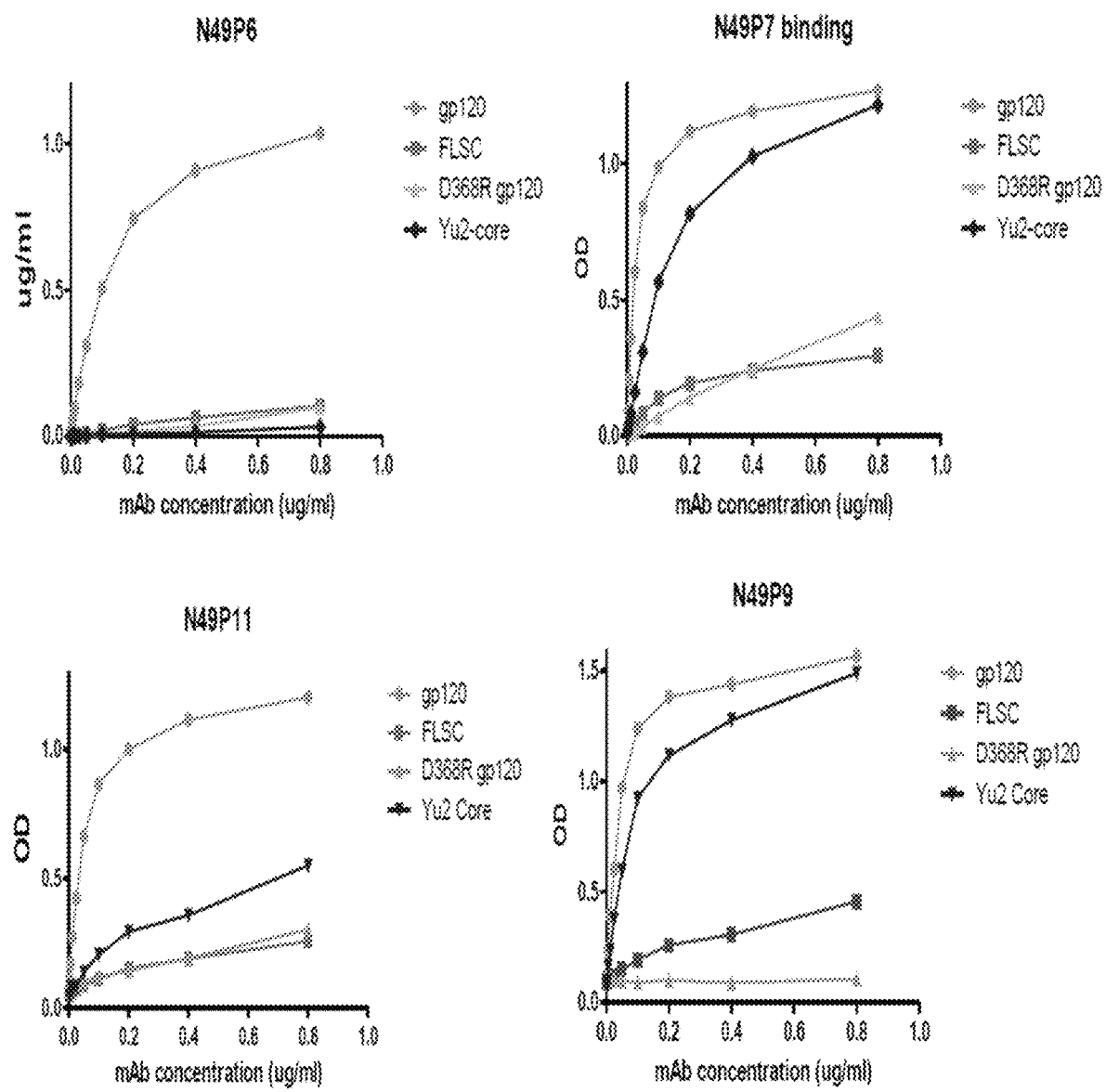
FIG. 12. ELISA Reactivity of the N49 antibodies isolated. Dilutions of each mAb was tested by ELISA for reactivity against the indicated HIV antigens: BaL-gp120 monomer, BaL-gp120 monomer with the D368R mutation to abrogate CD4-BS binding, Yu2 gp120 core, and full length single chain (FLSC), presenting a full length CD4-induced gp120 structure in which the CD4-BS is occupied. X-axis shows mAb concentration in ug/ml, and Y axis the background-subtracted OD.
Figure 13:
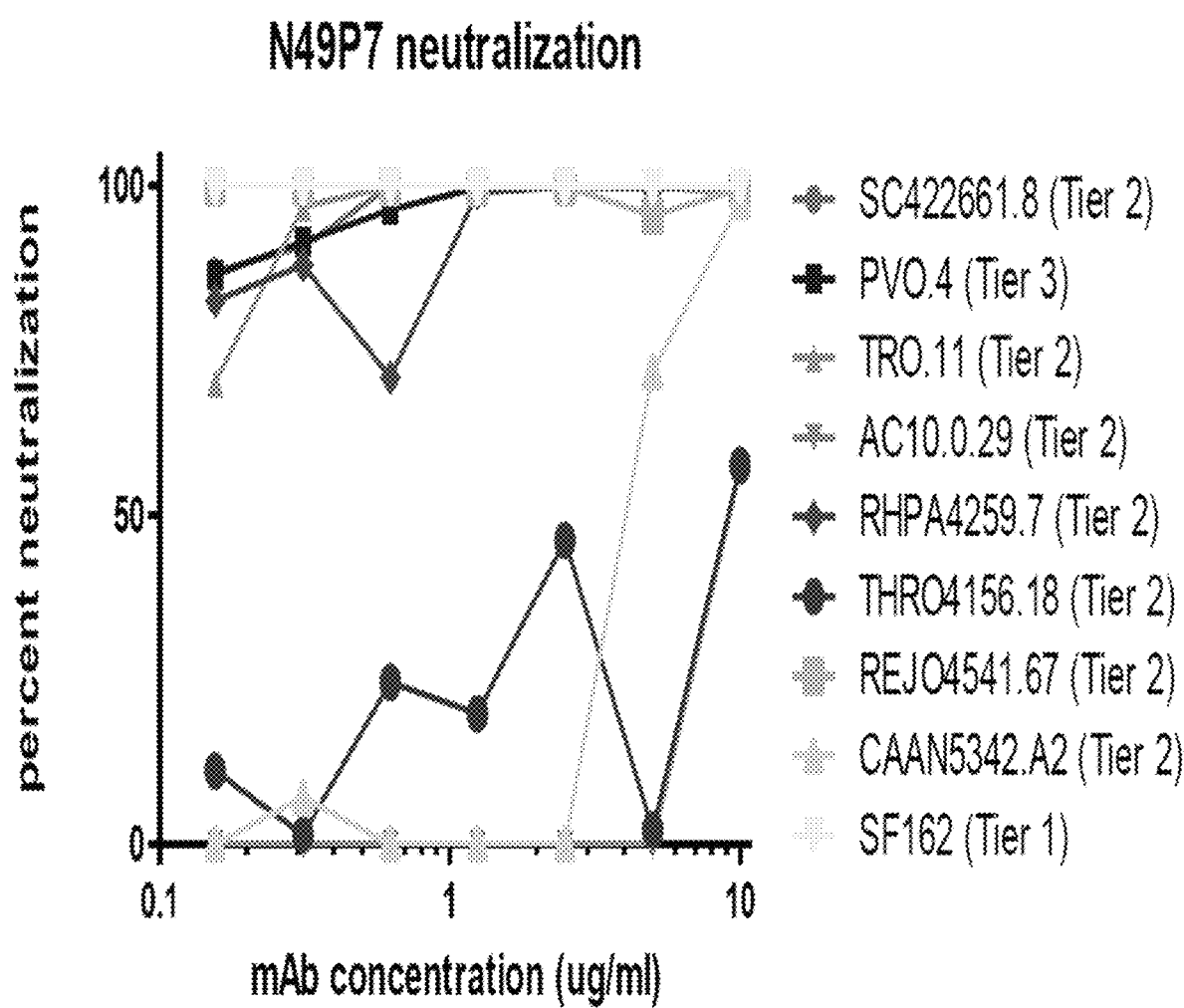
FIG. 13. Neutralization activity of N49P7 against a panel of Clade B pseudoviruses. Purified IgG was tested for neutralizing activity against the indicated pseudoviruses. SF Fab-gp120$_{93THO57}$ core$_e$ complex is shown in the center with the molecular surface displayed over the Fab molecule to highlight the shape of the formed antigen binding site. The complementarity-determining regions (CDRs) are shown in green (CDR L1), blue (CDR L3), black (CDR H1), yellow (CDR H2), and red (CDR H3). The gp120 outer and inner domains are colored in black and gray, respectively. The D (S$^{274}$-T$^{283}$), E5 (F$^{353}$-T$^{358}$), V5 (T$^{455}$-N$^{465}$) and the CD4 binding (Q$^{362}$-G$^{372}$) loops are colored in cyan, orange, violet and magenta, respectively. The bottom panel shows the sequence alignments of the variable light and heavy regions of N49P7 and N6 (Huang et al., 2016). The unique features of the gp120 antigen recognition mediated by N49P7 are shown (from 1 to 6) and discussed in details in the blow up view figures: (1) 'Super short' CDR L1-The CDRL1 of N49P7 consists of 8 amino acids (aa), 1 and 3 aa shorter than the CDRL1 of VRCOI and N6, respectively. The short CDR L1 avoids steric clashes with loop D and Loop E and permits the accommodation of complex and bulky glycans linked to N$^{276}$ and N$^{355}$ of gp120. The figure shows the overlay of the N49P7 Fab-gp120$_{93THO57}$ core$_e$ and the N6 Fab-gp120$_{93THO57}$ core$_e$ complex (Huang et al., 2016). Structures were superimposed based upon gp120 to show differences in the length and position of CDR L1 relative to the gp120 antigen (colored dark green for N49P7 and light green for N6) (2) Unpaired cysteine (C$^{36}$) in a framework 2 (FW2) of the light chain. Both κ (as seen in N6) and λ light chains have a tyrosine at position of 36 of FW2. Replacement of this bulky residue by cysteine changes the packing of the hydrophobic core formed at the variable light (V$_L$) and heavy (V$_H$) domain interface of N49P7 as compared to N6. The result of the unique packing is a difference in the relative orientations (rotation/tilting) of V$_L$- and V$_H$ observed in N49P7 relative to N6. The figure shows the V$_L$-V$_H$ core packing of N49P7 and N6. Fabs were superimposed based of VH domain. N6 is colored light and dark blue for light and heavy chain, respectively (CD1 L1 as in panel 1). (3) Rotation/tilting of the light chain-the assembly of V$_L$ and VH domains of N49P7 forms an asymmetric antigen binding side, wildly open from the V$_L$ side and protruding from the VH side. The open access from the V$_L$ side is due to the rotation/tilting of the light chain relative to the heavy chain as described in (2). The figure shows the same superimposition as in panel 2. The V$_L$ of N49P7 is rotated approximately 12 degrees (measured at the V$_L$ N-termini) away from Loops D and VS of gp120. This generates a 5 Å distance between the V$_L$ N-termini of N49P7 and N6. The wild opening of the VL side of the P7 antigen binding site combined with short CDRL1 allows N49P7 to accommodate different lengths of the highly variable loops D, E and V5. Changes in the length of gp120 loop V5 and the length (and glycosylation status) of loop E that cause steric clashes with an antibody CDRL1 were described previously as mechanisms of HIV-1 resistance to VRC01-class antibodies. (4) Long CDRH3 that contacts to Loop D and the inner domain of gp120. The CDRH3 of N49P7 consists of 19 aa that contact the conserved Loop D of gp120 and reach deeply into the gp120 inner domain (compared to the 13 aa-long CDRH3 of N6). The CDRH3 contributes 274 Å$^2$ BSA to the complex interface (28.6% of the BSA of the whole Fab). A network of interactions is formed which includes hydrogen bonds formed by Lys of CDRH3 (of a S$^{100}$GK motif) and residues of the al helix of Layer 2 and the α7-helix of Layer 3 of the inner domain. (5) 'By passing' the Phe43 cavity. The CDRH2 of N49P7 is a major anchor point in binding to the gp120 antigen contributing 489 Å$^2$ BSA to the complex interface (51% of the BSA of the whole Fab) but it lacks Glycine at position 54 (Tyrosine in N6) thus it is unable to anchor deeply inside the Phe43 cavity of the CD4BS. Instead N49P7 makes important contacts to inner domain mediated trough M$^{53}$ and Q$^{56}$ which compensate for lack of direct contacts to residues of the Phe43 cavity. Overall N49P7 contributes 207 Å$^2$ of its buried surface area (BSA) to the gp120 inner domain which is the highest among N6 and the VRC01 Abs class. The figure shows a blow up view of the CDRH2-gp120 interface of N49P7 and N6. CDRH2 is colored light and dark yellow for N49P7 and N6, respectively. (6) The P$^{60}$W motif in CDRH2. N49P7 is able to accommodate changes in length and conformation of the gp120 V5 loop through a P$^{60}$W motif of its CDRH2 which forms the framework for an interaction network with the base of the V5 loop. Figure shows a close-up view of the interaction of CDRH2 of N49P7 and N6 with Loop V5. The P$^{60}$W (N49P7) and G$^{60}$GG (N6) motifs are highlighted.

| mAb | Heavy chain | Light chain | Lambda Constant | Heavy mutation | Light mutation | pI | Notes |
|---|---|---|---|---|---|---|---|
| N49P7.2 | 1-2 | 2-11 | LC2 | 38% | 29% | 8.8 | Heavy: 8 AA mutation VDJ with N49P7/7.1<br>Heavy constant- 1 AA difference with N49P7.1<br>Light: DJ identical to N49P7/7.1<br>Light: V region 2 AA difference with N49P7/7.1 |
| N49P11 | 1-2 | 2-11 | LC2 | 35% | 30% | 8.4 | Lambda constant: 1 AA mutation |
| N49P18 | 1-2 | 2-11 | LC2 | 38% | 29% | 8.7 | Lambda constant: 1 AA mutation |
| N49P18.1 | 1-2 | 2-11 | LC2 | 34% | 31% | 8.7 | Heavy: V region 4 AA difference with N49P18<br>Heavy constant: 1 AA difference with N49P18<br>Light: V region 3 AA difference with N49P18 |
| N49P19 | 1-2 | 2-11 | LC2 | 39% | 28% | 8.9 | Lambda constant: 1 AA mutation |
| N49P9 | 1-2 | 2-23 | LC7 | 38% | 42% | 8.65 | Lambda constant: 1 AA mutation |
| N49P9.1 | 1-2 | 2-23 | LC2 | 38% | 42% | NT | Lambda constant: Contains N49P9 mutation but LC2 instead of LC7. | mAb = monoclonal antibody.
VDJ = Variable Diversity Junction.
LC = Lambda constant.
AA = amino acid.
Mutation = somatic hypermutation given as a percent of germline V region for heavy chains, and VJ region for light chains.
NT = not tested The antibodies from these 2 families target the CD4-binding site region of HIV-gp120. Currently, we have several lines of evidence to support this. Inspection of the protein sequence of the antibodies reveal characteristic phenotype of CD4-BS antibodies:
1) Heavy chain: usage of the 1-2 Heavy chain, usage of Trp50, Asn58, and Arg71 at the noted positions
2) Light Chain: usage of a deletion in CDRL3 rendering it 5 amino acids long, as well as a deletion in CDRL1 (FIG. 12).
3) Basic isoelectric point None of the antibodies tested thus far can bind BaL D368R mutant, while they can bind the BaL gp120 monomer. The difference in the 2 antigens is a single point mutation at position 368, which abrogates binding of CD4-BS antibodies to HIV-1 gp120 (Li et al., *Nat Med* 13, 1032-1034 (2007)) (FIG. 12). Finally, crystallography reveals binding the region of the CD4-BS.

Antibodies N49P6, N49P7, N49P9, and N49P11 were evaluated by their ability to neutralize HIV-1 against a panel of pseudoviruses in our lab. N49P6 and N49P7 demonstrated the best neutralization with ability to neutralize all the viruses tested (see FIG. 13 for N49P7 neutralization).

The following antibodies were sent for extensive testing at Dr. Michael Seaman's lab at Harvard University: N49P6, N49P7, N49P7.1, N49P11, and N49P9. Dr. Seaman uses a panel of 118 HIV-1 pseudoviruses that represent multi-clade and difficult to neutralize strains from around the world. Dr. Seaman's lab is a reference lab for neutralization testing, and he has worked with all of the major HIV-1 broadly neutralizing antibodies that have been created. In Dr. Seaman's panel, the antibodies tested performed better than all the antibodies he has worked with before. Specifically: N49P6, N49P7, and N49P11 demonstrated 100% neutralization breadth (able to neutralize all the viruses by IC50 in the panel), N49P7.1 demonstrated 99% neutralization, and N49P9 demonstrated 89% neutralization (Individual IC50 and IC80 values against each pseudovirus are in the Excel file "N49 neutralization and sequences").

Beyond their ability to neutralize 100% of the viruses, the importance of these antibodies are that they can neutralize viruses that other broadly neutralizing antibodies are resistant to. The antibodies from N49 were able to neutralize all the viruses that the other mAbs were resistant to (importantly all the neutralization data was from the same lab). A summary of the neutralization breadth of the NVS49 antibodies compared to the others described are provided in Table 13 below.

TABLE 13

Comparison of neutralization breadth between those derived from NVS49 and those in the literature. Percentages are given as values of viruses neutralized (IC50 < 50 ug/ml)/viruses tested. All testing was carried independent of the inventors by Dr. Seaman at Harvard.

| mAb | % neutralization |
|---|---|
| N49P6 | 100% |
| N49P7 | 100% |
| N49P7.1 | 99% |
| N49P11 | 100% |
| N49P9 | 89% |
| PGT121 | 65.8% |
| PGT128 | 59.8% |
| PGT145 | 74% |
| PGDM1400 | 79.8% |
| PGT151 | 65.5% |
| 10-1074 | 56.8% |
| 10E8 | 94.9% |
| PG9 | 84.7% |
| PG16 | 82.2% |
| 3BNC117 | 90% |
| NIH 45-46 | 86.4% |
| 8ANC195 | 65.2% |
| VRC07 | 91.5% |
| VRC01 | 87.6% |

Recently, there has been a report of a new broadly neutralizing antibody, N6, which has more breadth than other HIV broadly neutralizing antibodies (Huang et al., *Immunity* 45, 1108-1121 (2016)). Dr. Seaman has only tested this antibody against a Clade C panel, and so we can not compare N6 with our antibodies directly. However, N49 P6, N49P7, and N49P11 has the ability to neutralize viruses that N6 was unable to (such as T278-50). These results show that the antibodies engineered from NVS49 are truly unique and are the broadest mAbs against HIV-1 that have been described to date. Currently, there are a variety of human and animal clinical trials that are addressing the utility of anti-HIV monoclonal antibodies for the prevention, treatment, or cure of HIV-1. These take the form of either using broadly neutralizing antibodies or their derivatives (engineered to have longer half-life, activity coupled with drugs, etc.). We anticipate that the extreme breadth and potency of the antibodies described above will make them highly useful in HIV research and for the prevention, treatment, or cure of HIV-1. In addition these mAbs can be used to select (purify) native trimers.

Example 3. Antibody Variants

Figure 14A:
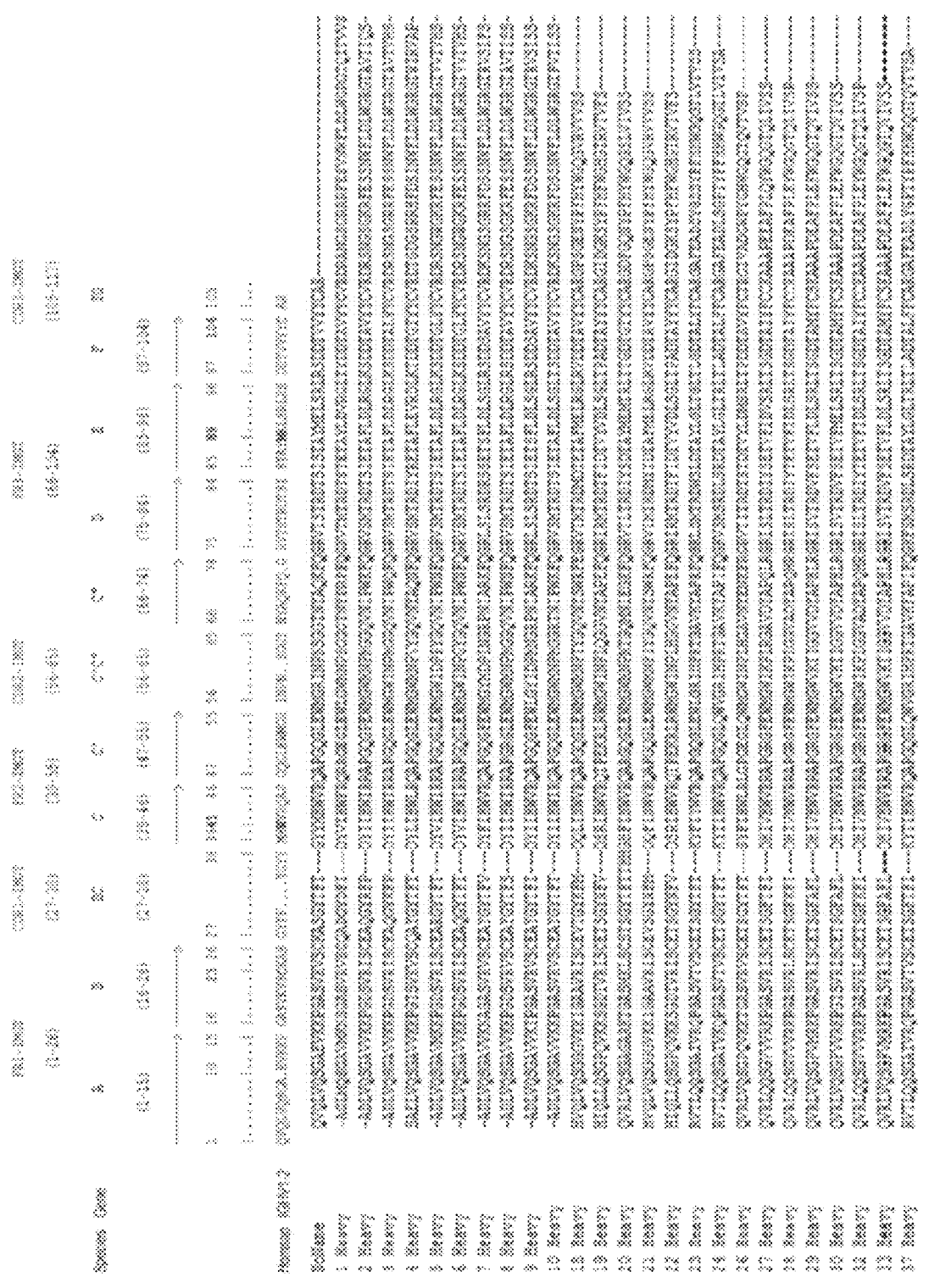
Figure 14B:
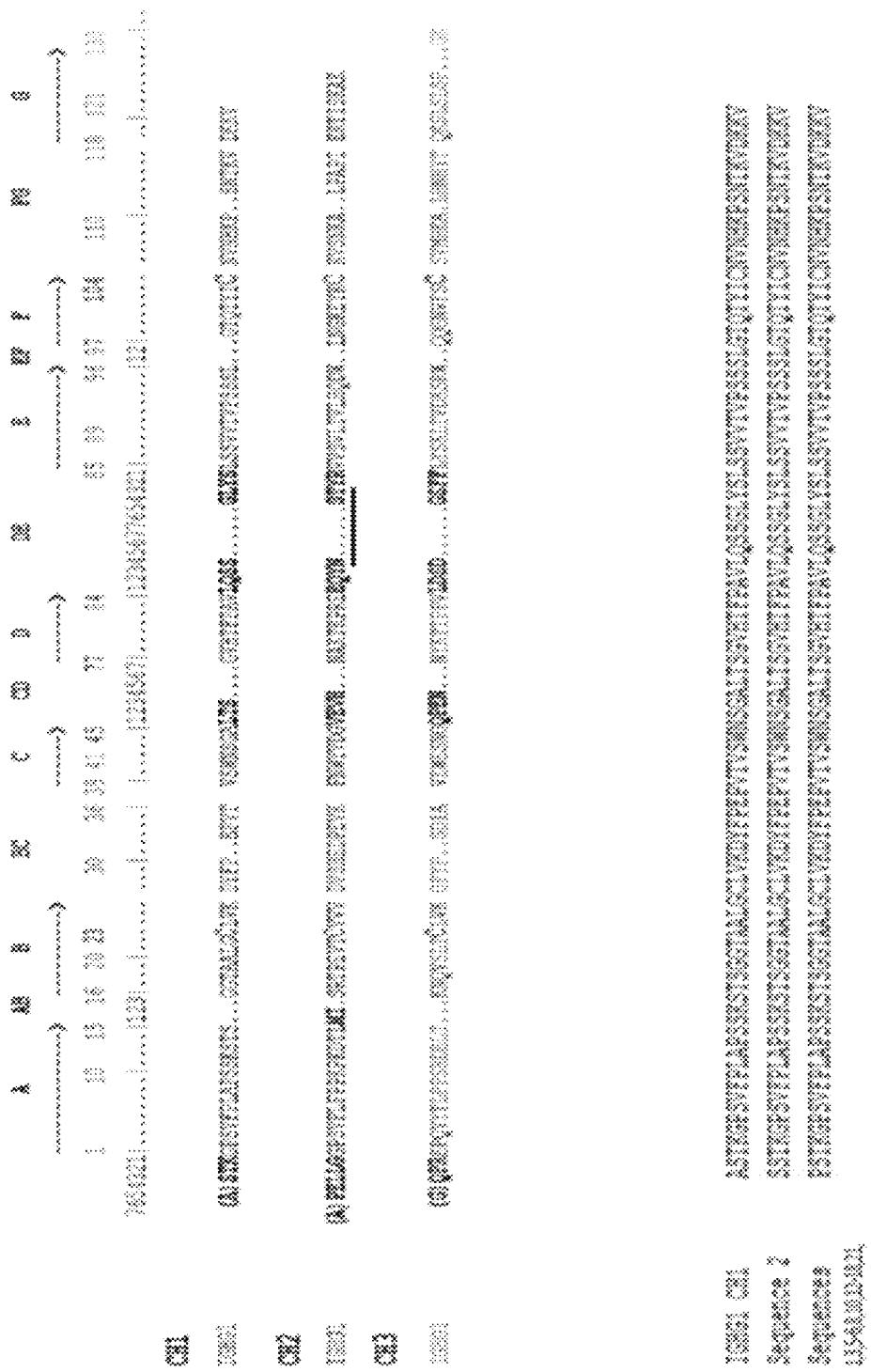
Figure 15B:
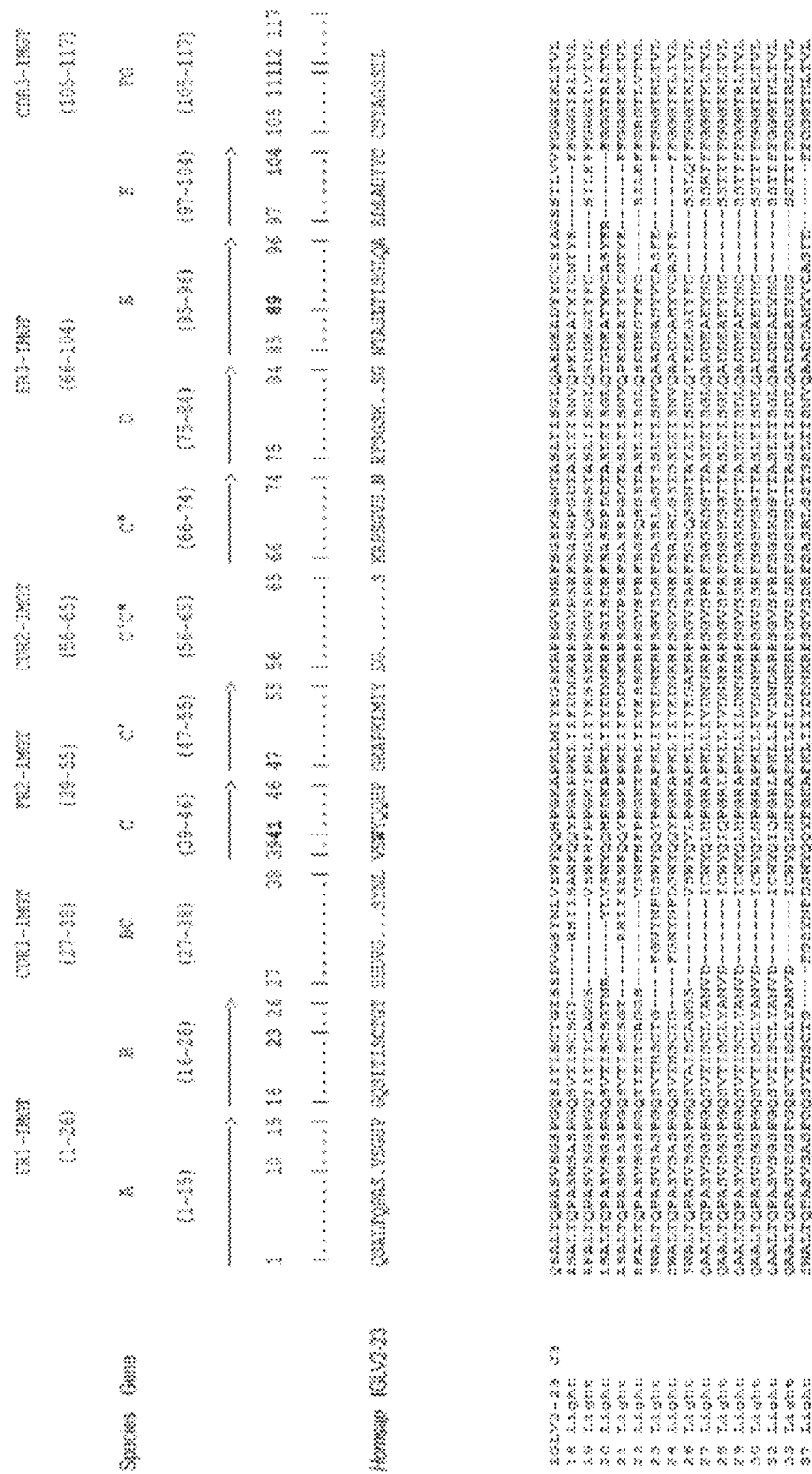
Figure 16A:
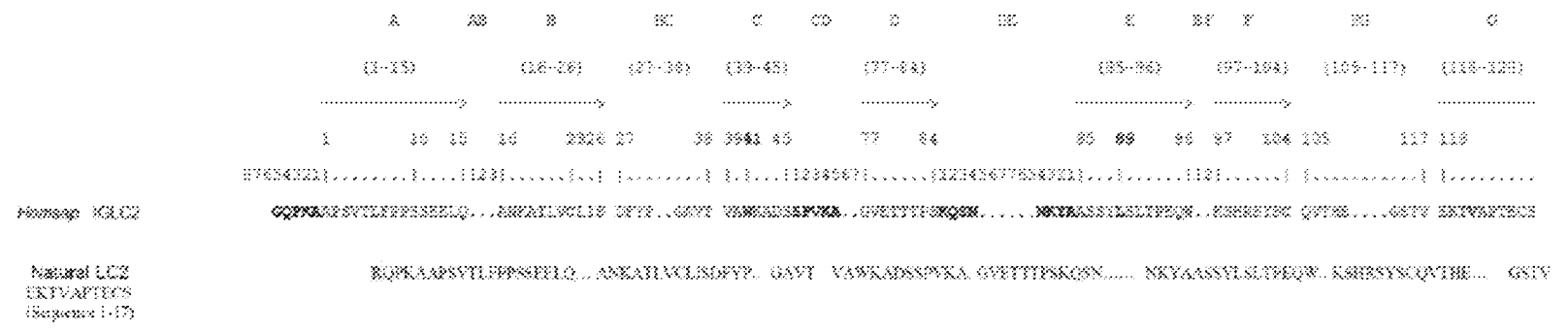
Figure 16B:
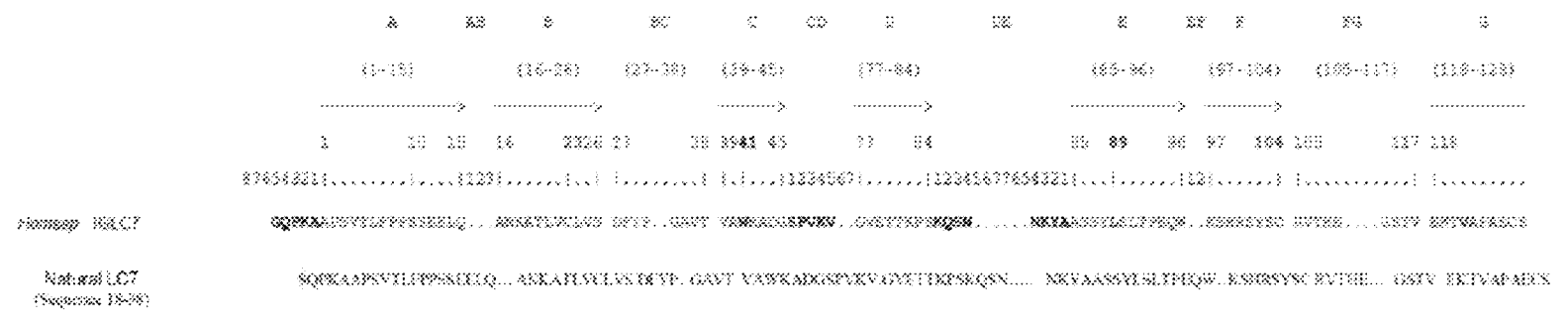
Figure 17A:
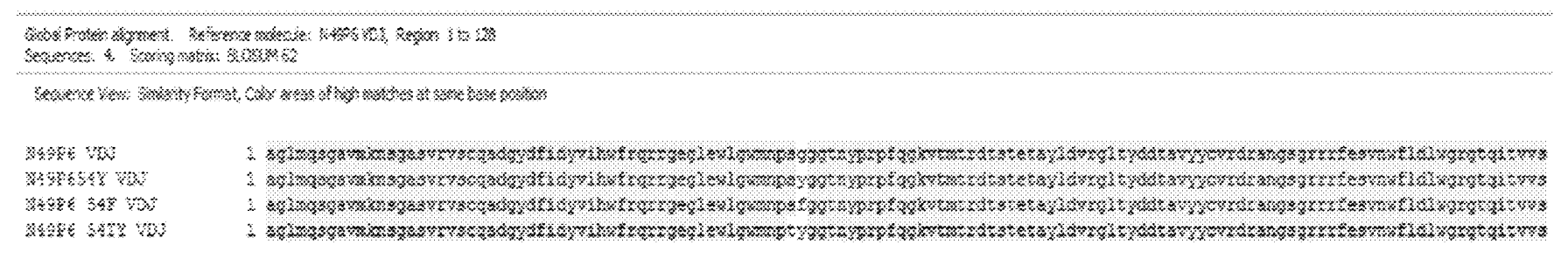

This example contains additional details about modifications made to antibodies and contains a number of new antibodies. All antibody numbering is now based on IMGT (see FIGS. 14, 15, and 16), so a few of the individual positions are different than what was listed before (see also FIGS. 17 and 18 for aligned N49P6 and N49P7 mutants). Variants are described in Table 4, above.

Modifications of Antibodies:
1) Modifications to improve stability.
   Heavy chain modifications: Substitution at position 1.4 of CH1 ($1^{st}$ amino acid of the constant region) to A from P or S. Substitution at position 120 of CH1 to R. Substitution at position 12 of CH3 to E, at position 14 of CH3 to M.
   Light chain modifications: modifications to change the unpaired cysteine to another amino acid that has potentially better pharmacokinetic properties: substitutions at IMGT position 42 (Cysteine) to A, S, Y, or F. Other light chain modifications include substitution at position 1.5 of the light chain constant region ($1^{st}$ amino acid of the constant region) from R to S or G for those that use LC2, or from S to R or G for those that use LC7.
2) Modifications to improve antibody function (binding, neutralization, complement fixation, ADCC, ADCP).
   Heavy chain modifications: Dual substitution at positions 59 and 62 to T and Y, respectively. Substitution of Y, F, W, or H at position 62. Substitution at position 1.4 of CH1 ($1^{st}$ amino acid of the constant region) to G from P or S. Substitution at position 120 of CH1 to R. Substitution at position 12 of CH3 to E, at position 14 of CH3 to M.
   Light chain modifications: Substitution at position 1.5 of the light chain constant region ($1^{st}$ amino acid of the constant region) from R to S or G for those that use LC2, or from S to R or G for those that use LC7.
3) Modifications to improve antibody half-life.
   Heavy chain modifications with combinations of any of the following substitutions: Substitution at position 120 of CH1 to R. Substitution at position 12 of CH3 to E, at position 14 of CH3 to M. Substitution at position 101 of CH3 to I, 107 of CH3 to L, position 113 of CH3 to S, position 115 to R.
4) Constant region swapping: Swapping of light chain constant region: light chain constant region swapped to another lambda constant region (LC1-7) for improved stability and function. Another method of swapping will be used to make monoclonals that are "rhesusized," that is, retain the variable regions in the heavy and light chains, but use constant regions from rhesus lambda chain (such as LC3), as well as rhesus IgG1. These mAbs can also have the half-life extending mutations noted above in the corresponding amino acids of the rhesus IgG1 constant region.
5) Swapping of heavy and light chain variable regions: These include taking a native or modified antibody listed in this application and mixing and matching the heavy and light chains to improve antibody stability or function. For example, one such antibody is made from the heavy chain of the parent antibody N49P7.1 (a variant of sequence 2) with the light chain from the parent antibody N49P9 (a variant of sequence 18). We have already made a number of these. As they can be readily expressed suggests the similarity in the gene family usage, and targeted epitopes makes these mAb swaps feasible to make and test. These swaps can also be made with other antibodies that target the same epitope (such as N60P1, N60P1.1, N60P2.1, N60P23, N60P31.1, N60P44, N60P45, VRC01, N6, etc.).
6) CDR replacement mutants: These include taking the CDRH1, CDRH2, CDRH3, CDRL1, CDRL2, and/or CDRL3 from one of the natural or modified antibodies listed in this application and inserting into the corresponding CDR another natural or modified antibody from this application. For example, we have made an antibody with the CDR3 of sequence 2, inserted and replacing the CDR3 of N49P9 (a variant of sequence 18).
7) Antibody-drug conjugates: The natural and modified antibodies listed here can be conjugated (covalently or non-covalently) to markers (florescent dye or radionuclides), toxins, or therapeutic agents. We have constructed a conjugate between N49P7 and auristatin (a microtubule toxin).
8) Pharmaceutical compositions: These can include antibodies (pre-made in a variety of vehicles) delivered via injection, or genes encoding antibodies delivered via a viral or other vector.
9) Antibody-bead conjugates. The modified antibodies listed here can be conjugated to agarose or other beads by a variety of chemical reactions (such as but not limited to Cyanogen Bromide-Activated and NHS esters) for the purpose of creating affinity purification columns that can bind (and purify) gp120 and its mutants, gp160 and its mutants, HIV trimers, or HIV-1 virus.
10) Antibodies, their modifications, and fragments, can be used for the purpose of HIV prevention, treatment, or cure, and can be done individually or in combination with any number of anti-HIV treatments.

Example 4. Crystallographic Analysis of the Broadly Neutralizing Antibodies

To define the molecular basis for the broad potencies of N60 and N49 P mAbs series we solved the crystal structures of N60P23 and N49P7 Fabs in complex with HIV-1 93TH0S7 gp120 (Table 14).

TABLE 14

Data collection and refinement statistics.

|  | N49-P7 Fab-gp120$_{93TH057}$ core$_e$ | N60-P23 Fab-gp120$_{93TH057}$ core$_e$ |
|---|---|---|
| Data collection | | |
| Wavelength, Å | 0.979 | 0.979 |
| Space group | P2$_1$2$_1$2$_1$ | C2 |
| Cell parameters | | |
| a, b, c, Å | 61.4, 63.9, 255.3 | 127.6, 68.6, 119.4 |
| α, β, γ, ° | 90, 90, 90 | 90, 111.4, 90 |
| Complexes/a.u. | 1 | 1 |
| Resolution, (Å) | 50-2.69 (2.74-2.69) | 50-2.38 (2.43-2.38) |
| # of reflections | | |
| Total | 73,281 | 139,212 |
| Unique | 23,639 | 38,617 |
| R$_{merge}$$^b$, % | 13.1 (74.9) | 16.0 (90.8) |
| R$_{pim}$$^c$, % | 7.7 (42.9) | 9.7 (62.5) |
| CC$_{1/2}$$^d$ | 0.99 (0.67) | 0.99 (0.47) |
| Wilson B$_{factor}$ (1/Å$^2$)$^e$ | 53 | 30 |
| I/σ | 9.3 (1.1) | 9.7 (1.2) |
| Completeness, % | 80.6 (72.2) | 100 (99.0) |
| Redundancy | 3.1 (3.2) | 3.6 (2.9) |
| Refinement Statistics | | |
| Resolution, Å | 50.0-2.7 | 50.0-2.4 |
| R$^f$, % | 22.5 | 21.4 |
| R$_{free}$$^g$, % | 28.5 | 25.8 |
| # of atoms | | |
| Protein | 5,822 | 5,905 |
| Water | 27 | 222 |
| Ligand/Ion | 170 | 133 |
| Overall B value (Å)$^2$ | | |
| Protein | 50 | 44 |
| Water | 33 | 36 |
| Ligand/Ion | 64 | 59 |
| Root mean square deviation | | |
| Bond lengths, Å | 0.014 | 0.009 |
| Bond angles, ° | 1.2 | 1.4 |
| Ramachandran$^h$ | | |
| favored, % | 89.0 | 93.5 |
| allowed, % | 9.7 | 5.8 |
| outliers, % | 1.3 | 0.7 |
| PDB ID | 6BCK | 5WB9 |

Values in parentheses are for highest-resolution shell
$^b$R$_{merge}$ = Σ | I − <I> |/ΣI, where I is the observed intensity and <I> is the average intensity obtained from multiple observations of symmetry-related reflections after rejections
$^c$R$_{pim}$ = as defined in (Weiss, 2001)
$^d$CC$_{1/2}$ = as defined by Karplus and Diederichs (Karplus and Diederichs, 2012)
$^e$Wilson B$_{factor}$ as calculated in (Popov and Bourenkov, 2003)
$^f$R = Σ || F$_o$ | − | F$_c$ ||/Σ | F$_o$ |, where F$_o$ and F$_c$ are the observed and calculated structure factors, respectively
$^g$R$_{free}$ = as defined by Brünger (Brunger, 1997)
$^h$Calculated with MolProbity.

Figure 19:
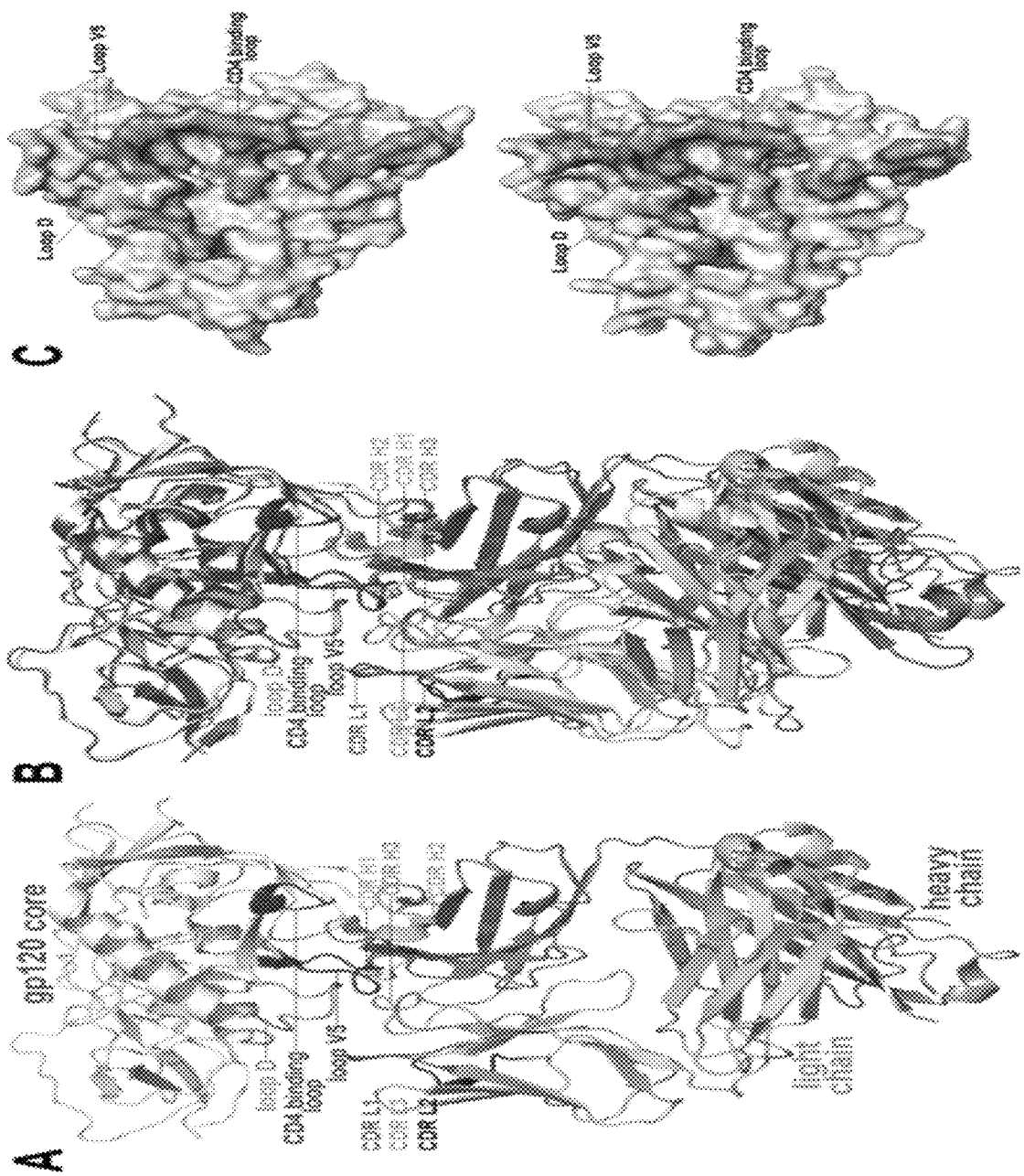
Figure 19:
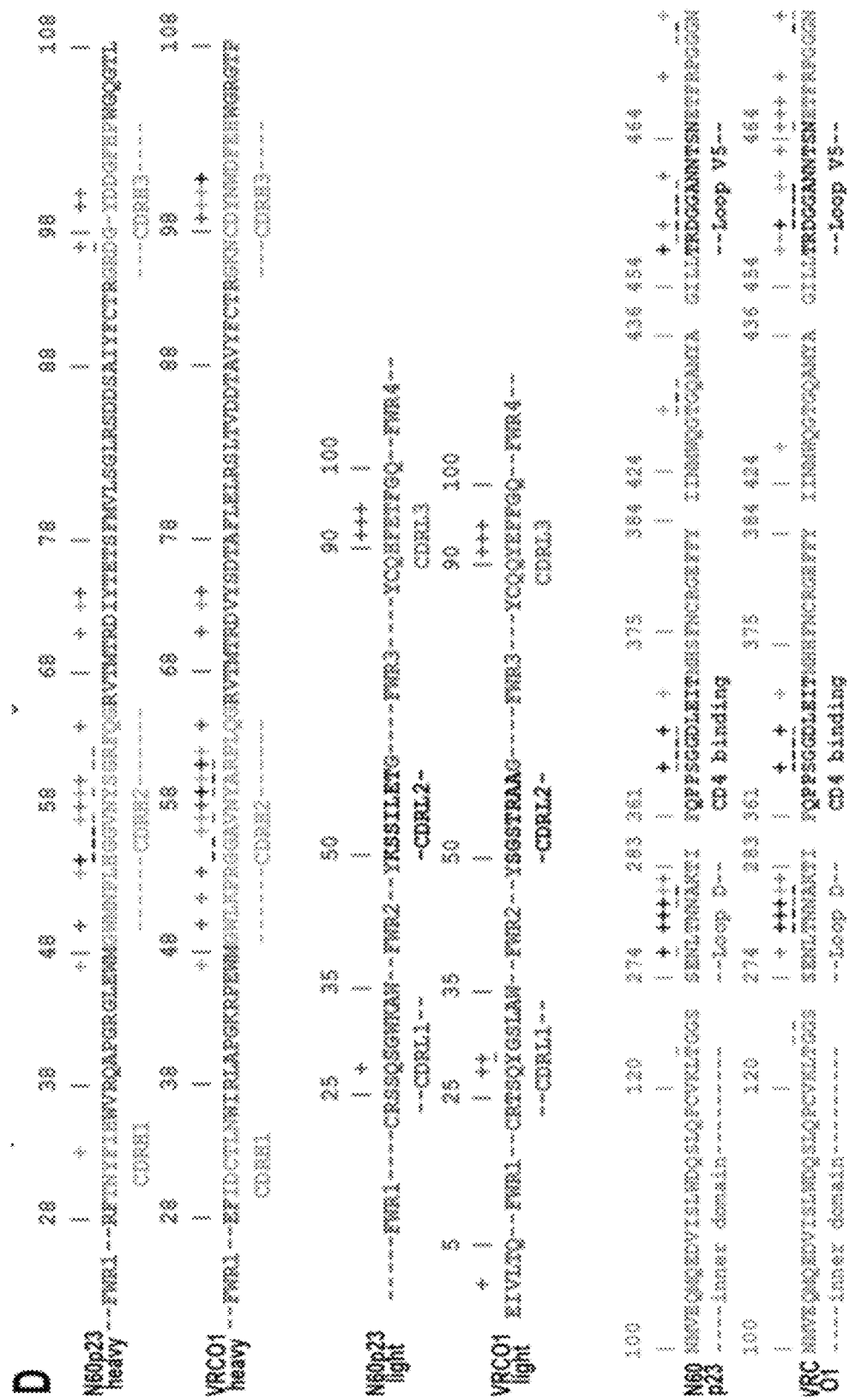

N60P23, a clone of N60 P1.1 that has a 1 amino acid (aa) difference in the light chain, exhibited an epitope footprint with intermolecular contacts similar to those of VRCO1 and other previously described CD4bs antibodies (FIG. 19 and Table 15). In contrast, N49P7 bound to gp120 in a unique manner (FIG. 20).

TABLE 15

Details of the N49_P7-gp120$_{93TH057}$ core$_e$, N60_P23-gp120$_{93TH057}$ core$_e$, N6-gp120$_{93TH057}$ core$_e$, and VRCO1-gp120$_{93TH057}$ core$_e$ interfaces. Results as calculated by the EBI PISA server.

|  |  | N49_P7 Fab-gp120$_{93TH057}$ core$_e$ | N60_P23 Fab-gp120$_{93TH057}$ core$_e$ | N6 Fab-gp120$_{93TH057}$ core$_e$ (5te6) | VRCO1-gp120$_{93TH057}$ core$_e$ (3ngb) |
|---|---|---|---|---|---|
| Buried Surface Area, Å$^2$ | gp120total | 981 | 939 | 1132 | 1143 |
|  | Outer domain (OD) | 774 | 872 | 1000 | 1036 |
|  | Inner domain (ID) | 207 | 67 | 132 | 107 |
|  | Ratio of OD/ID | 3.74 | 13.01 | 7.58 | 9.68 |
|  | Loop D of OD | 339 | 346 | 332 | 322 |
|  | CD4 binding loop of OD | 186 | 202 | 206 | 188 |
|  | Loop V5 of OD | 164 | 209 | 339 | 301 |
|  | Heavy chain total | 821 | 726 | 928 | 897 |
|  | FWR | 54 | 158 | 146 | 136 |
|  | CDR H1 | 4 | 20 | 38 | 3 |
|  | CDR H2 | 489 | 435 | 621 | 598 |
|  | CDRH3 | 274 | 113 | 123 | 160 |
|  | Light chain total | 138 | 243 | 251 | 306 |
|  | FWR | 0 | 0 | 36 | 124 |
|  | CDR L1 | 9 | 67 | 43 | 50 |
|  | CDR L2 | 0 | 0 | 0 | 0 |
|  | CDR L3 | 129 | 176 | 172 | 132 |
|  | Heavy and light chain total | 959 | 969 | 1179 | 1203 |

Figure 18A:
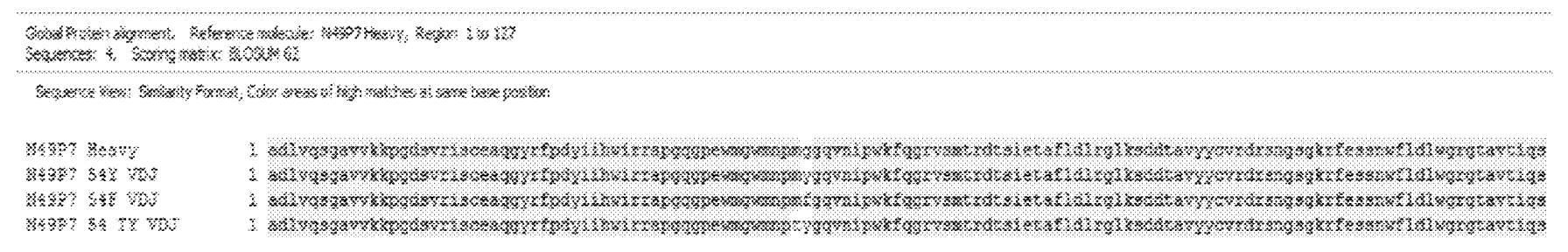

The deletion in the CDRL1 (not found in N6) combined with the rotation/tilting of the light chain 'opens' the variable light (V1) side of the N49P7 antigen binding site to accommodate different lengths of the highly variable loops D, E and VS (FIG. 21). Changes in the length of gp120 loop VS and the length (and glycosylation status) of loop E that cause steric clashes with an antibody light chain were described previously as mechanisms of HIV-I resistance to VRC01-class antibodies (Lynch et al., 2015). These signatures, along with along CDRH3 (19 aa) and unique sequence signatures within CDR.B2 (not seen in VRCO1 and N6, FIG. 21), allow N49P7 to bypass the Phe43 cavity affording it an unusual capacity to contact the gp120 inner domain at residues 97, 102 and 124 of Layer 2, and 472-480 of Layer 3 (FIG. 18). Overall N49P7 contributes 207 Å$^2$ of its buried surface area (BSA) to the gp120 inner domain which is much higher than N6 and the VRCOI Abs class (Table 15). The gp120 inner domain harbors some of the most conserved amino acid sequences in the HIV envelope, located within structural Layers 1, 2 and 3 and a consolidation of 8 P-strands (Finzi et al., 2010). Other CD4bs antibodies such as N6 and VRCOI also display contacts with the inner domain; however, these are less prominent. Although NIH 45-46 is not as broad and potent and N49P7, it has previously shown to have more contacts with the inner domain (mostly Layer 2) than VRCOI (Diskin et al., 2011), and it was postulated that this may be the reason for the breadth. N49P7 is unique in the number of inner domain contacts (especially Layer 3). N49P7 exhibits a lower outer domain to inner domain buried surface area ratio (3.74) compared to N6 (7.58) and VRCO1 (9.68), which shows it has significantly more contacts with the inner domain (Table 15). Thus, the N49P7 paratope recognizes a mixed inner domain/CD4-binding site (termed here the iCD4bs) containing some of the most conserved sequences in gp120. These features help explain the extreme neutralization breadth of the antibody.

Methods

Crystallization Initial crystal screens were done in robotic vapor-diffusion sitting drop trials using a Gryphon Protein Crystallization Robot (Art Robbins Instruments) with commercially available sparse matrix crystallization screens from Molecular Dimensions (Proplex and MacroSol), Emerald Biosystems (Precipitant Wizard Screen) and Emerald BioSystems (Synergy Screen). The screens were monitored periodically for protein crystals. Conditions that produced micro crystals were then reproduced and optimized using the hanging-drop, vapor diffusion method with drops of 0.5 μl protein and 0.5 μl precipitant solution. For the N60P23 complex conditions producing diffraction quality crystals came from 0.1 M Magnesium acetate hexahydrate, 0.065.M NaCl and 0.1 M MOPS pH 7.5 after incubation at 22° C. N49P7 complex crystals came from 10% PEG 5000 MME, 12% isopropanol, and 0.1 MMES pH 6.5. Crystals were frozen in liquid nitrogen after a brief soak in mother liquor supplemented with 20% MPD prior to being used for data collection.

Data collection and structure solution and refinement. Diffraction data for N60P23 Fab- and N49P7 Fab-gp$120_{93TH057}$ core$_e$ complexes were collected at the Stanford Synchrotron Radiation Light Source (SSRL) at the beam line BL14 1 (N60P23) and BL12-2 (N49P7) equipped with Marmosaic 325 or Pilatus area detectors respectively. N60P23 crystals belong to a space group C2 with the unit-cell parameters a=127.6, b=68. 6, c=119.4 A and =111.4° with one N60P23 Fab-gp$120_{93TH057}$ core$_e$ complex present in the asymmetric unit (ASU). N49P7 crystals belong to space group P2$_1$2$_1$2$_1$ with the unit-cell parameters a=61.4, b=63.9, and c=255.3 Å with one N49P7 Fab-gp$120_{93TH057}$ core$_e$ complex present in the ASU. Data was processed and reduced with HKL2000, as previously described (Guan et al., 2013). The data for the N49P7 complex was highly anisotropic and was further processed using the STARANISO server (Global Phasing Ltd.). The N60P23 structure was solved by molecular replacement with Phaser from the CCP4 suite based on the coordinates of gp120 (PDB: 3TGT) and the VRCO1 Fab (PDB: 4RFE) for the N6P23 Fab. N49P7 was solved using coordinates of gp120 (PDB: 3TGT) and N5-I5 Fab (PDB: 3TNN) for the N49P7 Fab. Refinement was done with Refmac and/or Phenix, coupled with manual refitting and rebuilding using COOT, as previously described (Guan et al., 2013). The N60P23 complex complex was refined to an R-factor of 0.214 and an R-free of 0.258 and the N49P7 complex was refined to an R-factor of 0.225 and R-free of 0.285. Data collection and refinement statistics are shown in (Table 14).

Structure validation and analysis. The quality of the final refined model was monitored using the program MolProbity, as previously described (Guan et al., 2013). Structural alignments were performed using the Dali server and the program lsqkab from CCP4 suite. The PISA webserver was used to determine contact smfaces and interface residues. All illustrations were prepared with the PyMol Molecular Graphic suite (DeLano Scientific, San Carlos, CA, USA).

Data Availablity. The data reported in this paper are archived at the following databases: GenBank and Protein Data Bank (PDB).

Example 5. Neutralization Assays of HIV Antibody Variants

Shown in this example are neutralization assay data of various anti-HIV antibodies of the invention across an Env pseudovirus panel (See Table).

TABLE 16

Neutralization assay data of mAbs against Env pseudovirus panel. mAbs tested at primary concentration of 50 ug/ml, 25 ug/ml, or 17 ug/ml and titrated 5-fold 7x (duplicate wells).

| TABLE 16 | | Titer in TZM.bl cells (ug/ml) | | | | | | | | | | | |
|---|---|---|---|---|---|---|---|---|---|---|---|---|---|
| | | N49P7A | | | N49P7S | | | N49P7-54TY | | | N49P7YTE | | |
| Virus ID | Clade* | IC50 | IC80 | MPI | IC50 | IC80 | MPI | IC50 | IC80 | MPI | IC50 | IC80 | MPI |
| PVO.4 | B | 0.079 | 0.205 | 100 | 0.035 | 0.132 | 100 | 0.079 | 0.314 | 100 | 0.088 | 0.394 | 100 |
| AC10.0.29 | B | >17 | >17 | 45 | 36.004 | >50 | 55 | >25 | >25 | 40 | >50 | >50 | 28 |
| 62357_14_D3_4589 | B (T/F) | 0.031 | 0.105 | 100 | 0.020 | 0.074 | 100 | 0.055 | 0.192 | 100 | 0.039 | 0.173 | 100 |
| Du172.17 | C | 0.088 | 0.376 | 100 | 0.055 | 0.282 | 100 | 0.124 | 0.529 | 100 | 0.283 | 0.953 | 100 |
| Du422.1 | C | 2.417 | 13.266 | 85 | 6.131 | 48.813 | 82 | 0.402 | 2.022 | 96 | 13.224 | >50 | 76 |
| CAP210.2.00.E8 | C | 0.729 | 5.618 | 94 | 0.640 | 3.233 | 100 | 0.691 | 3.329 | 97 | 3.109 | 13.903 | 99 |

TABLE 16-continued

Neutralization assay data of mAbs against Env pseudovirus panel. mAbs tested at primary concentration of 50 ug/ml, 25 ug/ml, or 17 ug/ml and titrated 5-fold 7x (duplicate wells).

| | | Titer in TZM.bl cells (ug/ml) | | | | | | | | | | |
|---|---|---|---|---|---|---|---|---|---|---|---|---|
| TABLE 16 | | N49P7A | | | N49P7S | | | N49P7-54TY | | | N49P7YTE | | |
| Virus ID | Clade* | IC50 | IC80 | MPI | IC50 | IC80 | MPI | IC50 | IC80 | MPI | IC50 | IC80 | MPI |
| Ce1086_B2 | C (T/F) | 0.072 | 0.349 | 100 | 0.042 | 0.166 | 100 | 0.067 | 0.339 | 100 | 0.113 | 0.530 | 99 |
| Ce1172_H1 | C (T/F) | >17 | >17 | 4 | >50 | >50 | 1 | >25 | >25 | 23 | >50 | >50 | 12 |
| CNE20 | BC | 0.045 | 0.122 | 100 | 0.038 | 0.141 | 100 | 0.046 | 0.160 | 100 | 0.110 | 0.317 | 99 |
| Q259.d2.17 | A | 0.273 | 2.511 | 93 | 0.814 | 6.528 | 91 | 0.132 | 1.129 | 95 | 5.340 | 44.139 | 82 |
| 191955_A11 | A (T/F) | 3.118 | >17 | 75 | 10.158 | >50 | 72 | 3.045 | >25 | 72 | 39.028 | >50 | 56 |
| T250-4 | CRF02_AG | 2.460 | >17 | 74 | 12.223 | >50 | 65 | 1.020 | 19.555 | 83 | >50 | >50 | 43 |
| 620345.c01 | CRF01_AE | >17 | >17 | 0 | >50 | >50 | 0 | >25 | >25 | 0 | >50 | >50 | 0 |
| R1166.c01 | CRF01_AE | 0.076 | 0.349 | 100 | 0.050 | 0.172 | 100 | 0.131 | 0.470 | 100 | 0.232 | 0.782 | 100 |
| BJOX028000.10.3 | CRF01_AE (T/F) | 0.029 | 0.177 | 100 | 0.009 | 0.034 | 100 | 0.009 | 0.044 | 100 | 0.018 | 0.155 | 100 |
| X1254_c3 | G | 3.732 | >17 | 71 | 16.977 | >50 | 71 | 0.145 | 0.599 | 100 | 26.154 | >50 | 59 |
| X2088_c9 | G | 0.084 | 0.381 | 100 | 0.083 | 0.275 | 100 | 0.172 | 0.572 | 100 | 0.329 | 1.060 | 100 |
| 3016.v5.c45 | D | 0.275 | 1.801 | 92 | 0.635 | 6.393 | 92 | 0.206 | 1.908 | 92 | 1.151 | 9.654 | 89 |
| 6952.v1.c20 | CD | >17 | >17 | 16 | >50 | >50 | 18 | >25 | >25 | 20 | >50 | >50 | 13 |
| 6545.v4.c1 | | 6.807 | >17 | 62 | 12.387 | >50 | 63 | 3.014 | >25 | 74 | >50 | >50 | 45 |
| 3103.v3.c10 | ACD | 0.061 | 0.239 | 100 | 0.057 | 0.168 | 100 | 0.151 | 0.550 | 100 | 0.322 | 0.583 | 100 |
| MuLV | Neg. Control | >17 | >17 | 0 | >50 | >50 | 0 | >25 | >25 | 0 | >50 | >50 | 4 |

Example 6. Neutralization Assays of HIV Antibody Variants

Shown in this example are neutralization assay data of various HIV antibodies of the invention and known HIV antibodies across an extended multiclade virus panel (See Tables 17-25).

TABLE 17

Neutralization assay data of NS49 plasma and NS49 P6 mAbs against extended multiclade virus panel. mAbs tested at primary concentration of 50 ug/ml and titrated 5-fold 7x (duplicate wells).

| | | Titer in TZM.bl cells (ug/ml) | | | | |
|---|---|---|---|---|---|---|
| TABLE 17 | | NVS49 Plasma | | NVS49 P6 | | |
| Virus ID | Clade* | ID50 | ID80 | IC50 | IC80 | MPI |
| 6535.3 | B | 460 | 93 | 0.417 | 1.341 | 100 |
| QH0692.42 | B | 207 | 71 | 0.652 | 2.276 | 100 |
| SC422661.8 | B | 427 | 125 | 0.129 | 0.360 | 100 |
| PVO.4 | B | 543 | 143 | 0.128 | 0.357 | 100 |
| TRO.11 | B | 568 | 208 | 0.061 | 0.190 | 100 |
| AC10.0.29 | B | 114 | <40 | 32.310 | >50 | 67 |
| RHPA4259.7 | B | 830 | 346 | 0.117 | 0.443 | 100 |
| THRO4156.18 | B | 144 | 46 | 12.487 | 38.403 | 89 |
| REJO4541.67 | B | 925 | 244 | 0.066 | 0.215 | 100 |
| TRJO4551.58 | B | 356 | 134 | 0.255 | 0.874 | 100 |
| WITO4160.33 | B | 641 | 170 | 0.096 | 0.277 | 100 |
| CAAN5342.A2 | B | 342 | 103 | 0.657 | 1.829 | 100 |
| WEAU_d15_410_787 | B (T/F) | 709 | 271 | 0.070 | 0.188 | 100 |
| 1006_11_C3_1601 | B (T/F) | 879 | 293 | 0.068 | 0.209 | 100 |
| 1054_07_TC4_1499 | B (T/F) | 163 | <40 | 0.624 | 2.848 | 100 |
| 1056_10_TA11_1826 | B (T/F) | 314 | 51 | 0.209 | 0.606 | 100 |
| 1012_11_TC21_3257 | B (T/F) | 354 | 83 | 0.137 | 0.502 | 100 |
| 6240_08_TA5_4622 | B (T/F) | 127 | <40 | 0.567 | 1.757 | 100 |
| 6244_13_B5_4576 | B (T/F) | 318 | 78 | 0.095 | 0.328 | 100 |
| 62357_14_D3_4589 | B (T/F) | 363 | 112 | 0.098 | 0.296 | 100 |
| SC05_8C11_2344 | B (T/F) | 355 | 90 | 0.266 | 0.911 | 100 |
| Du156.12 | C | 1,519 | 355 | 0.082 | 0.280 | 100 |
| Du172.17 | C | 687 | 100 | 20.759 | >50 | 74 |
| Du422.1 | C | 160 | <40 | 44.007 | >50 | 57 |
| ZM197M.PB7 | C | 251 | 63 | 3.001 | 12.401 | 98 |
| ZM214M.PL15 | C | 295 | 41 | 0.510 | 1.802 | 100 |
| ZM233M.PB6 | C | 250 | 56 | 1.233 | 4.005 | 99 |
| ZM249M.PL1 | C | 345 | 116 | 0.112 | 0.376 | 100 |

TABLE 17-continued

Neutralization assay data of NS49 plasma and NS49 P6 mAbs against extended multiclade virus panel. mAbs tested at primary concentration of 50 ug/ml and titrated 5-fold 7x (duplicate wells).

| | | Titer in TZM.bl cells (ug/ml) | | | | |
|---|---|---|---|---|---|---|
| TABLE 17 | | NVS49 Plasma | | NVS49 P6 | | |
| Virus ID | Clade* | ID50 | ID80 | IC50 | IC80 | MPI |
| ZM53M.PB12 | C | 121 | 42 | 0.538 | 1.706 | 100 |
| ZM109F.PB4 | C | 591 | 170 | 0.084 | 0.290 | 99 |
| ZM135M.PL10a | C | 438 | 68 | 0.494 | 1.775 | 99 |
| CAP45.2.00.G3 | C | 398 | 67 | 21.663 | >50 | 75 |
| CAP210.2.00.E8 | C | 104 | <40 | 22.582 | >50 | 73 |
| HIV-001428-2.42 | C | 1,810 | 764 | 0.016 | 0.050 | 100 |
| HIV-0013095-2.11 | C | 330 | 96 | 0.971 | 8.044 | 96 |
| HIV-16055-2.3 | C | 774 | 200 | 0.117 | 0.586 | 100 |
| HIV-16845-2.22 | C | 254 | 52 | 0.692 | 3.754 | 100 |
| Ce1086_B2 | C (T/F) | 680 | 148 | 0.581 | 4.086 | 98 |
| Ce0393_C3 | C (T/F) | 496 | 79 | 0.608 | 3.249 | 100 |
| Ce1176_A3 | C (T/F) | 327 | 52 | 0.594 | 2.114 | 100 |
| Ce2010_F5 | C (T/F) | 386 | 83 | 0.124 | 0.749 | 100 |
| Ce0682_E4 | C (T/F) | 1,378 | 246 | 0.095 | 0.315 | 100 |
| Ce1172_H1 | C (T/F) | 112 | <40 | 14.353 | 47.253 | 82 |
| Ce2060_G9 | C (T/F) | 146 | <40 | 0.888 | 4.812 | 100 |
| Ce703010054_2A2 | C (T/F) | 837 | 155 | 0.245 | 0.841 | 100 |
| BF1266.431a | C (T/F) | 1,228 | 255 | 0.083 | 0.283 | 100 |
| 246F C1G | C (T/F) | 727 | 240 | 0.513 | 2.510 | 99 |
| 249M B10 | C (T/F) | 296 | 95 | 0.122 | 0.549 | 100 |
| ZM247v1(Rev-) | C (T/F) | 274 | 60 | 0.063 | 0.170 | 100 |
| 7030102001E5(Rev-) | C (T/F) | 515 | 161 | 0.354 | 1.171 | 100 |
| 1394C9G1(Rev-) | C (T/F) | 230 | 59 | 17.498 | >50 | 80 |
| Ce704809221_1B3 | C (T/F) | 534 | 139 | 1.667 | 12.774 | 97 |
| CNE19 | BC | 1,095 | 289 | 0.044 | 0.156 | 100 |
| CNE20 | BC | 233 | 40 | 2.739 | 15.642 | 95 |
| CNE21 | BC | 174 | 43 | 0.832 | 6.517 | 99 |
| CNE17 | BC | 172 | <40 | 0.340 | 2.103 | 100 |
| CNE30 | BC | 159 | 57 | 0.457 | 1.536 | 100 |
| CNE52 | BC | 1,078 | 467 | 0.028 | 0.095 | 100 |
| CNE53 | BC | 457 | 151 | 0.249 | 0.871 | 99 |
| CNE58 | BC | 1,025 | 352 | 0.036 | 0.100 | 100 |
| MS208.A1 | A | 578 | 102 | 0.110 | 0.436 | 100 |
| Q23.17 | A | 496 | 184 | 0.052 | 0.185 | 100 |
| Q461.e2 | A | 199 | 68 | 0.173 | 0.622 | 100 |
| Q769.d22 | A | 498 | 169 | 0.072 | 0.318 | 100 |
| Q259.d2.17 | A | 316 | 88 | 24.376 | >50 | 75 |
| Q842.d12 | A | 1,430 | 546 | 0.034 | 0.091 | 100 |
| 3415.v1.c1 | A | 491 | 170 | 0.188 | 0.648 | 100 |
| 3365.v2.c2 | A | 521 | 193 | 0.129 | 0.347 | 100 |
| 0260.v5.c36 | A | 173 | <40 | 0.485 | 1.551 | 100 |
| 191955_A11 | A (T/F) | 151 | 44 | 0.124 | 0.344 | 100 |
| 191084 B7-19 | A (T/F) | 552 | 184 | 0.062 | 0.257 | 100 |
| 9004SS_A3_4 | A (T/F) | 783 | 202 | 0.181 | 0.817 | 100 |
| T257-31 | CRF02_AG | 330 | 105 | 0.147 | 0.535 | 100 |
| 928-28 | CRF02_AG | 178 | 50 | 1.242 | 5.604 | 99 |
| 263-8 | CRF02_AG | 1,091 | 321 | 0.116 | 0.438 | 100 |
| T250-4 | CRF02_AG | 631 | 167 | 21.927 | >50 | 68 |
| T251-18 | CRF02_AG | 263 | 83 | 0.344 | 0.929 | 100 |
| T278-50 | CRF02_AG | 45 | <40 | 25.690 | >50 | 67 |
| T255-34 | CRF02_AG | 1,005 | 295 | 0.076 | 0.392 | 100 |
| 211-9 | CRF02_AG | 403 | 85 | 8.494 | 27.679 | 93 |
| 235-47 | CRF02_AG | 984 | 379 | 12.976 | 46.426 | 82 |
| 620345.c01 | CRF01_AE | <40 | <40 | 22.899 | >50 | 70 |
| CNE8 | CRF01_AE | 688 | 244 | 0.072 | 0.245 | 100 |
| C1080.c03 | CRF01_AE | 852 | 106 | 0.181 | 0.661 | 100 |
| R2184.c04 | CRF01_AE | 2,504 | 535 | 0.028 | 0.077 | 100 |
| R1166.c01 | CRF01_AE | 677 | 186 | 0.102 | 0.344 | 100 |
| R3265.c06 | CRF01_AE | NT | NT | 0.101 | 0.443 | 100 |
| C2101.c01 | CRF01_AE | 1,943 | 252 | 0.140 | 0.597 | 100 |
| C3347.c11 | CRF01_AE | 1,772 | 405 | 0.080 | 0.266 | 100 |
| C4118.c09 | CRF01_AE | 877 | 150 | 0.092 | 0.243 | 100 |
| CNE5 | CRF01_AE | 401 | 93 | | | |
| BJOX009000.02.4 | CRF01_AE | 139 | 43 | 0.320 | 1.463 | 100 |
| BJOX015000.11.5 | CRF01_AE (T/F) | 783 | 133 | 0.070 | 0.312 | 100 |
| BJOX010000.06.2 | CRF01_AE (T/F) | 230 | 54 | 0.681 | 3.529 | 100 |
| BJOX025000.01.1 | CRF01_AE (T/F) | 422 | 59 | 14.946 | >50 | 78 |

TABLE 17-continued

Neutralization assay data of NS49 plasma and NS49 P6 mAbs against extended multiclade virus panel. mAbs tested at primary concentration of 50 ug/ml and titrated 5-fold 7x (duplicate wells).

| TABLE 17 | | Titer in TZM.bl cells (ug/ml) | | | | |
|---|---|---|---|---|---|---|
| | | NVS49 Plasma | | NVS49 P6 | | |
| Virus ID | Clade* | ID50 | ID80 | IC50 | IC80 | MPI |
| BJOX028000.10.3 | CRF01_AE (T/F) | 3,724 | 175 | 6.678 | >50 | 77 |
| X1193_c1 | G | 993 | 185 | 0.074 | 0.224 | 100 |
| P0402_c2_11 | G | 512 | 113 | 3.536 | 18.954 | 99 |
| X1254_c3 | G | 172 | 63 | 15.739 | 34.230 | 91 |
| X2088_c9 | G | 133 | 46 | 27.036 | >50 | 65 |
| X2131_C1_B5 | G | 600 | 97 | 0.174 | 0.720 | 100 |
| P1981_C5_3 | G | 293 | 91 | 0.310 | 0.708 | 100 |
| X1632_S2_B10 | G | 97 | <40 | 23.063 | >50 | 69 |
| 3016.v5.c45 | D | 234 | 52 | 21.668 | >50 | 72 |
| A07412M1.vrc12 | D | 233 | 54 | 0.229 | 0.786 | 100 |
| 231965.c01 | D | 136 | 46 | 9.245 | 39.386 | 87 |
| 231966.c02 | D | 258 | 94 | 0.339 | 1.621 | 100 |
| 3817.v2.c59 | CD | 54 | <40 | 16.922 | >50 | 78 |
| 6480.v4.c25 | CD | 1,140 | 246 | 0.089 | 0.427 | 100 |
| 6952.v1.c20 | CD | 328 | 91 | 16.912 | >50 | 78 |
| 6811.v7.c18 | CD | 164 | 48 | 0.238 | 1.008 | 100 |
| 89-F1_2_25 | CD | 78 | <40 | 33.639 | >50 | 61 |
| 3301.v1.c24 | AC | 1,006 | 268 | 0.054 | 0.149 | 100 |
| 6041.v3.c23 | AC | 1,317 | 281 | 5.525 | 43.153 | 88 |
| 6540.v4.c1 | AC | 766 | 245 | 13.973 | 47.540 | 81 |
| 6545.v4.c1 | AC | 165 | 49 | 24.487 | >50 | 76 |
| 0815.v3.c3 | ACD | 2,249 | 346 | 0.194 | 1.251 | 100 |
| 3103.v3.c10 | ACD | 324 | 87 | 0.582 | 1.567 | 100 |
| MuLV | Neg. Control | <40 | <40 | >50 | >50 | 0 |

*(T/F): Transmitted/Founder Virus

TABLE 18

Neutralization assay data of NS49 P7 and NS49 P7.1 mAbs against extended multiclade virus panel. mAbs tested at primary concentration of 50 ug/ml and titrated 5-fold 7x (duplicate wells).

| TABLE 18 | | Titer in TZM.bl cells (ug/ml) | | | | | |
|---|---|---|---|---|---|---|---|
| | | NVS49 P7 | | | NVS49 P7.1 | | |
| Virus ID | Clade* | IC50 | IC80 | MPI | IC50 | IC80 | MPI |
| 6535.3 | B | 0.186 | 0.598 | 100 | 0.224 | 0.715 | 100 |
| QH0692.42 | B | 0.663 | 2.411 | 100 | 0.764 | 2.710 | 100 |
| SC422661.8 | B | 0.114 | 0.320 | 100 | 0.125 | 0.417 | 100 |
| PVO.4 | B | 0.107 | 0.365 | 100 | 0.124 | 0.421 | 100 |
| TRO.11 | B | 0.044 | 0.160 | 100 | 0.055 | 0.191 | 100 |
| AC10.0.29 | B | 5.034 | 36.661 | 89 | 5.308 | 46.750 | 85 |
| RHPA4259.7 | B | 0.083 | 0.246 | 100 | 0.108 | 0.292 | 100 |
| THRO4156.18 | B | 2.341 | 12.410 | 99 | 3.068 | 12.603 | 98 |
| REJO4541.67 | B | 0.015 | 0.049 | 100 | 0.022 | 0.088 | 100 |
| TRJO4551.58 | B | 0.104 | 0.351 | 100 | 0.156 | 0.529 | 100 |
| WITO4160.33 | B | 0.084 | 0.248 | 100 | 0.121 | 0.326 | 100 |
| CAAN5342.A2 | B | 0.409 | 1.211 | 100 | 0.550 | 1.589 | 100 |
| WEAU_d15_410_787 | B (T/F) | 0.045 | 0.117 | 100 | 0.058 | 0.142 | 100 |
| 1006_11_C3_1601 | B (T/F) | 0.044 | 0.158 | 100 | 0.061 | 0.193 | 100 |
| 1054_07_TC4_1499 | B (T/F) | 0.494 | 2.308 | 100 | 0.627 | 2.980 | 100 |
| 1056_10_TA11_1826 | B (T/F) | 0.141 | 0.468 | 100 | 0.171 | 0.603 | 100 |
| 1012_11_TC21_3257 | B (T/F) | 0.046 | 0.125 | 100 | 0.063 | 0.176 | 100 |
| 6240_08_TA5_4622 | B (T/F) | 0.457 | 1.728 | 100 | 0.509 | 1.951 | 100 |
| 6244_13_B5_4576 | B (T/F) | 0.111 | 0.386 | 100 | 0.184 | 0.493 | 100 |
| 62357_14_D3_4589 | B (T/F) | 0.025 | 0.102 | 100 | 0.028 | 0.150 | 100 |
| SC05_8C11_2344 | B (T/F) | 0.164 | 0.403 | 100 | 0.189 | 0.688 | 100 |
| Du156.12 | C | 0.032 | 0.086 | 100 | 0.045 | 0.131 | 100 |
| Du172.17 | C | 0.102 | 0.668 | 100 | 0.185 | 0.748 | 100 |
| Du422.1 | C | 4.496 | 19.548 | 93 | 3.763 | 15.661 | 93 |
| ZM197M.PB7 | C | 0.109 | 0.347 | 100 | 0.144 | 0.539 | 100 |
| ZM214M.PL15 | C | 0.213 | 0.953 | 100 | 0.257 | 0.853 | 100 |
| ZM233M.PB6 | C | 0.226 | 0.774 | 100 | 0.355 | 1.246 | 100 |
| ZM249M.PL1 | C | 0.039 | 0.134 | 100 | 0.071 | 0.239 | 100 |

TABLE 18-continued

Neutralization assay data of NS49 P7 and NS49 P7.1 mAbs against extended multiclade virus panel.

TABLE 18-continued

Neutralization assay data of NS49 P7 and NS49 P7.1 mAbs against extended multiclade virus panel. mAbs tested at primary concentration of 50 ug/ml and titrated 5-fold 7x (duplicate wells).

| | | Titer in TZM.bl cells (ug/ml) | | | | | |
|---|---|---|---|---|---|---|---|
| | | NVS49 P7 | | | NVS49 P7.1 | | |
| Virus ID | Clade* | IC50 | IC80 | MPI | IC50 | IC80 | MPI |
| BJOX028000.10.3 | CRF01_AE (T/F) | 0.020 | 0.123 | 100 | 0.031 | 0.290 | 100 |
| X1193_c1 | G | 0.016 | 0.060 | 100 | 0.035 | 0.144 | 100 |
| P0402_c2_11 | G | 0.014 | 0.061 | 100 | 0.029 | 0.115 | 100 |
| X1254_c3 | G | 2.969 | 13.594 | 100 | 3.963 | 18.205 | 96 |
| X2088_c9 | G | 0.116 | 0.338 | 100 | 0.199 | 0.726 | 100 |
| X2131_C1_B5 | G | 0.081 | 0.273 | 100 | 0.129 | 0.431 | 100 |
| P1981_C5_3 | G | 0.113 | 0.274 | 100 | 0.216 | 0.494 | 100 |
| X1632_S2_B10 | G | 12.046 | 40.378 | 85 | 17.861 | >50 | 65 |
| 3016.v5.c45 | D | 0.221 | 1.037 | 100 | 0.559 | 2.542 | 100 |
| A07412M1.vrc12 | D | 0.108 | 0.645 | 100 | 0.232 | 1.070 | 100 |
| 231965.c01 | D | 0.054 | 0.193 | 100 | 0.106 | 0.364 | 100 |
| 231966.c02 | D | 0.102 | 0.430 | 100 | 0.203 | 0.705 | 100 |
| 3817.v2.c59 | CD | 0.716 | 3.726 | 99 | 1.484 | 8.359 | 97 |
| 6480.v4.c25 | CD | 0.031 | 0.113 | 100 | 0.056 | 0.192 | 100 |
| 6952.v1.c20 | CD | 18.386 | 38.898 | 91 | 26.274 | >50 | 71 |
| 6811.v7.c18 | CD | 0.229 | 0.992 | 100 | 0.321 | 1.460 | 100 |
| 89-F1_2_25 | CD | 21.631 | >50 | 80 | 41.582 | >50 | 58 |
| 3301.v1.c24 | AC | 0.025 | 0.069 | 100 | 0.041 | 0.111 | 100 |
| 6041.v3.c23 | AC | 0.047 | 0.222 | 100 | 0.078 | 0.366 | 100 |
| 6540.v4.c1 | AC | 11.747 | 33.167 | 92 | 14.695 | >50 | 75 |
| 6545.v4.c1 | AC | 2.001 | 14.657 | 96 | 1.147 | 15.962 | 92 |
| 0815.v3.c3 | ACD | 0.016 | 0.053 | 100 | 0.023 | 0.064 | 100 |
| 3103.v3.c10 | ACD | 0.158 | 0.509 | 100 | 0.229 | 0.772 | 100 |
| MuLV | Neg. Control | >50 | >50 | 9 | >50 | >50 | 4 |

*(T/F): Transmitted/Founder Virus

TABLE 19

Neutralization assay data of NS49 P7.2, NS49 P11, and NS49P18.1 mAbs against extended multiclade virus panel. mAbs tested at primary concentration of 50 ug/ml and titrated 5-fold 7x (duplicate wells).

| | | Titer in TZM.bl cells (ug/ml) | | | | | | | | |
|---|---|---|---|---|---|---|---|---|---|---|
| | | N49P7.2 | | | NVS49 P11 | | | N49P18.1 | | |
| Virus ID | Clade* | IC50 | IC80 | MPI | IC50 | IC80 | MPI | IC50 | IC80 | MPI |
| 6535.3 | B | 0.152 | 0.784 | 100 | 8.224 | 17.196 | 100 | 2.064 | 11.368 | 100 |
| QH0692.42 | B | 1.263 | 4.424 | 100 | 0.550 | 2.645 | 100 | >50 | >50 | 43 |
| SC422661.8 | B | 0.119 | 0.564 | 100 | 0.729 | 3.489 | 100 | 14.050 | 43.430 | 84 |
| PVO.4 | B | 0.237 | 0.831 | 100 | 0.248 | 1.169 | 100 | 9.650 | 40.160 | 84 |
| TRO.11 | B | 0.113 | 0.306 | 100 | 0.179 | 0.937 | 100 | 4.248 | 11.683 | 99 |
| AC10.0.29 | B | 44.175 | >50 | 53 | 5.523 | 19.972 | 100 | 20.021 | >50 | 71 |
| RHPA4259.7 | B | 0.100 | 0.289 | 100 | 0.202 | 0.956 | 100 | 4.340 | 21.426 | 98 |
| THRO4156.18 | B | 6.293 | 33.287 | 94 | 1.838 | 10.368 | 100 | >50 | >50 | 19 |
| REJO4541.67 | B | 0.018 | 0.080 | 100 | 10.785 | 27.072 | 100 | 4.079 | 30.128 | 89 |
| TRJO4551.58 | B | 0.210 | 0.673 | 100 | 0.183 | 0.656 | 100 | 4.437 | 14.717 | 99 |
| WITO4160.33 | B | 0.051 | 0.215 | 100 | 4.857 | 13.218 | 100 | 10.999 | 37.591 | 87 |
| CAAN5342.A2 | B | 0.809 | 2.805 | 100 | 9.027 | 20.805 | 100 | 16.089 | 49.066 | 83 |
| WEAU_d15_410_787 | B (T/F) | 0.052 | 0.150 | 100 | 1.703 | 6.019 | 100 | 4.266 | 15.463 | 98 |
| 1006_11_C3_1601 | B (T/F) | 0.085 | 0.237 | 100 | 0.125 | 0.487 | 100 | 2.804 | 9.658 | 99 |
| 1054_07_TC4_1499 | B (T/F) | 2.036 | 10.723 | 99 | 2.915 | 13.091 | 100 | >50 | >50 | 0 |
| 1056_10_TA11_1826 | B (T/F) | 0.114 | 0.771 | 100 | 4.774 | 14.202 | 100 | 30.532 | >50 | 62 |
| 1012_11_TC21_3257 | B (T/F) | 0.060 | 0.285 | 100 | 10.593 | 29.254 | 100 | 16.105 | >50 | 79 |
| 6240_08_TA5_4622 | B (T/F) | 0.812 | 2.869 | 100 | 0.720 | 2.998 | 100 | 35.211 | >50 | 60 |
| 6244_13_B5_4576 | B (T/F) | 0.331 | 1.043 | 100 | 1.119 | 5.446 | 100 | 33.375 | >50 | 61 |
| 62357_14_D3_4589 | B (T/F) | 0.030 | 0.121 | 100 | 0.599 | 3.561 | 100 | 10.408 | 47.969 | 82 |
| SC05_8C11_2344 | B (T/F) | 0.326 | 1.135 | 100 | 5.419 | 20.488 | 100 | 17.283 | >50 | 79 |
| Du156.12 | C | 0.058 | 0.210 | 100 | 2.396 | 12.008 | 100 | 1.877 | 6.812 | 100 |
| Du172.17 | C | 0.290 | 1.078 | 100 | 5.653 | 17.918 | 100 | 6.516 | 21.335 | 92 |
| Du422.1 | C | >50 | >50 | 22 | 8.815 | 21.224 | 100 | 21.519 | >50 | 75 |
| ZM197M.PB7 | C | 0.223 | 1.371 | 100 | 0.303 | 1.591 | 100 | 12.493 | 49.791 | 84 |
| ZM214M.PL15 | C | 0.559 | 4.532 | 100 | 1.347 | 8.976 | 100 | >50 | >50 | 20 |
| ZM233M.PB6 | C | 0.475 | 2.137 | 99 | 5.922 | 18.544 | 100 | 38.427 | >50 | 57 |
| ZM249M.PL1 | C | 0.073 | 0.256 | 100 | 3.637 | 17.421 | 100 | 4.159 | 19.807 | 98 |
| ZM53M.PB12 | C | 0.477 | 1.728 | 100 | 1.051 | 6.531 | 100 | 1.302 | 4.506 | 99 |

TABLE 19-continued

Neutralization assay data of NS49 P7.2, NS49 P11, and NS49P18.1 mAbs against extended multiclade virus panel. mAbs tested at primary concentration of 50 ug/ml and titrated 5-fold 7x (duplicate wells).

| TABLE 19 | | Titer in TZM.bl cells (ug/ml) | | | | | | | |
|---|---|---|---|---|---|---|---|---|---|
| | | N49P7.2 | | | NVS49 P11 | | | N49P18.1 | |
| Virus ID | Clade* | IC50 | IC80 | MPI | IC50 | IC80 | MPI | IC50 | IC80 | MPI |
| ZM109F.PB4 | C | 0.065 | 0.321 | 99 | 5.203 | 19.443 | 100 | 26.597 | >50 | 69 |
| ZM135M.PL10a | C | 0.596 | 2.801 | 99 | 3.968 | 16.630 | 100 | >50 | >50 | 46 |
| CAP45.2.00.G3 | C | 0.162 | 2.490 | 95 | 5.253 | 23.977 | 100 | 5.140 | 33.068 | 88 |
| CAP210.2.00.E8 | C | 3.943 | 21.717 | 95 | 5.119 | 19.418 | 100 | >50 | >50 | 11 |
| HIV-001428-2.42 | C | 0.010 | 0.036 | 100 | 0.221 | 1.643 | 100 | 1.131 | 8.312 | 100 |
| HIV-0013095-2.11 | C | 0.183 | 0.931 | 97 | 5.849 | 17.771 | 100 | >50 | >50 | 48 |
| HIV-16055-2.3 | C | 0.204 | 0.721 | 100 | 0.091 | 0.503 | 100 | 8.035 | 22.606 | 97 |
| HIV-16845-2.22 | C | 3.910 | 18.221 | 98 | 1.723 | 8.152 | 100 | >50 | >50 | 23 |
| Ce1086_B2 | C (T/F) | 0.166 | 1.005 | 100 | 2.187 | 11.745 | 100 | 8.979 | 48.001 | 92 |
| Ce0393_C3 | C (T/F) | 0.137 | 0.368 | 100 | 1.507 | 9.715 | 100 | 10.321 | 24.836 | 92 |
| Ce1176_A3 | C (T/F) | 0.332 | 1.079 | 100 | 0.946 | 6.047 | 100 | 32.478 | >50 | 61 |
| Ce2010_F5 | C (T/F) | 0.398 | 1.294 | 100 | 0.380 | 3.266 | 100 | 28.999 | >50 | 68 |
| Ce0682_E4 | C (T/F) | 0.067 | 0.233 | 100 | 0.091 | 0.387 | 100 | 3.946 | 21.075 | 96 |
| Ce1172_H1 | C (T/F) | >50 | >50 | 6 | 3.548 | 19.204 | 100 | 46.416 | >50 | 52 |
| Ce2060_G9 | C (T/F) | 0.821 | 2.809 | 100 | 3.333 | 13.172 | 100 | >50 | >50 | 37 |
| Ce703010054_2A2 | C (T/F) | 0.124 | 0.576 | 100 | 1.423 | 7.511 | 100 | 4.150 | 11.552 | 98 |
| BF1266.431a | C (T/F) | 0.029 | 0.159 | 100 | 0.998 | 7.128 | 100 | 3.482 | 20.778 | 93 |
| 246F C1G | C (T/F) | 0.049 | 0.192 | 100 | 8.481 | 20.920 | 100 | 3.395 | 20.214 | 97 |
| 249M B10 | C (T/F) | 0.095 | 0.349 | 100 | 3.544 | 12.947 | 100 | 5.706 | 23.139 | 94 |
| ZM247v1(Rev-) | C (T/F) | 0.177 | 2.497 | 96 | 7.483 | 21.473 | 100 | 10.869 | >50 | 79 |
| 7030102001E5(Rev-) | C (T/F) | 0.313 | 1.034 | 100 | 0.635 | 2.285 | 100 | 6.353 | 17.738 | 98 |
| 1394C9G1(Rev-) | C (T/F) | >50 | >50 | 20 | 6.129 | 22.341 | 100 | >50 | >50 | 17 |
| Ce704809221_1B3 | C (T/F) | 0.874 | 3.880 | 100 | 0.644 | 3.296 | 100 | 41.584 | >50 | 59 |
| CNE19 | BC | 0.033 | 0.129 | 100 | 0.437 | 5.503 | 100 | 2.343 | 9.638 | 99 |
| CNE20 | BC | 0.119 | 0.574 | 99 | 5.194 | 22.606 | 100 | 1.329 | 6.364 | 100 |
| CNE21 | BC | 48.266 | >50 | 51 | 7.399 | 21.949 | 100 | 7.933 | 29.198 | 95 |
| CNE17 | BC | 0.376 | 1.238 | 100 | 6.682 | 25.594 | 100 | 39.715 | >50 | 56 |
| CNE30 | BC | 0.362 | 1.197 | 100 | 0.889 | 4.452 | 100 | 13.131 | 32.152 | 93 |
| CNE52 | BC | 0.030 | 0.088 | 100 | 0.060 | 0.307 | 100 | 2.458 | 6.649 | 100 |
| CNE53 | BC | 0.100 | 0.277 | 100 | 0.430 | 2.880 | 100 | 4.083 | 21.770 | 97 |
| CNE58 | BC | 0.045 | 0.129 | 100 | 0.038 | 0.135 | 100 | 1.917 | 5.258 | 100 |
| MS208.A1 | A | 0.186 | 0.966 | 100 | 0.259 | 1.944 | 100 | 8.315 | 33.318 | 88 |
| Q23.17 | A | 0.051 | 0.200 | 100 | 0.034 | 0.254 | 100 | 1.160 | 6.932 | 100 |
| Q461.e2 | A | 0.472 | 2.237 | 100 | 0.363 | 2.150 | 100 | 24.690 | >50 | 68 |
| Q769.d22 | A | 0.029 | 0.140 | 100 | 0.048 | 0.308 | 100 | 4.916 | 18.335 | 97 |
| Q259.d2.17 | A | 38.484 | >50 | 54 | 8.419 | 21.433 | 100 | >50 | >50 | 37 |
| Q842.d12 | A | 0.045 | 0.200 | 100 | 0.027 | 0.103 | 100 | 3.041 | 8.132 | 100 |
| 3415.v1.c1 | A | 0.381 | 1.580 | 100 | 1.862 | 10.264 | 100 | >50 | >50 | 48 |
| 3365.v2.c2 | A | 0.066 | 0.267 | 100 | 0.064 | 0.452 | 100 | 4.725 | 14.309 | 99 |
| 0260.v5.c36 | A | 0.644 | 1.800 | 100 | 0.438 | 1.469 | 100 | 16.179 | 47.836 | 81 |
| 191955_A11 | A (T/F) | 44.507 | >50 | 56 | 2.741 | 15.296 | 100 | >50 | >50 | 33 |
| 191084 B7-19 | A (T/F) | 0.102 | 0.290 | 100 | 0.065 | 0.276 | 100 | 5.588 | 16.863 | 98 |
| 9004SS_A3_4 | A (T/F) | 0.266 | 1.618 | 100 | 0.296 | 3.242 | 100 | 3.021 | 13.950 | 99 |
| T257-31 | CRF02_AG | 0.627 | 1.786 | 100 | 0.700 | 2.901 | 100 | >50 | >50 | 48 |
| 928-28 | CRF02_AG | 0.347 | 1.107 | 100 | 5.456 | 24.965 | 100 | 22.732 | >50 | 71 |
| 263-8 | CRF02_AG | 0.095 | 0.641 | 100 | 0.064 | 0.259 | 100 | 3.964 | 41.037 | 90 |
| T250-4 | CRF02_AG | >50 | >50 | 15 | 6.278 | 25.585 | 100 | 4.863 | 15.084 | 94 |
| T251-18 | CRF02_AG | 0.222 | 0.741 | 100 | 3.054 | 16.697 | 100 | 22.990 | >50 | 70 |
| T278-50 | CRF02_AG | >50 | >50 | 33 | 7.628 | 25.130 | 100 | >50 | >50 | 36 |
| T255-34 | CRF02_AG | 0.167 | 0.527 | 100 | 0.418 | 3.830 | 100 | 10.413 | 33.757 | 90 |
| 211-9 | CRF02_AG | 0.363 | 1.220 | 100 | 5.672 | 18.196 | 100 | 18.321 | >50 | 73 |
| 235-47 | CRF02_AG | 0.127 | 1.034 | 90 | 3.876 | 21.250 | 100 | 23.013 | >50 | 66 |
| 620345.c01 | CRF01_AE | >50 | >50 | 0 | 11.662 | 27.932 | 100 | >50 | >50 | 0 |
| CNE8 | CRF01_AE | 0.073 | 0.240 | 100 | 0.165 | 1.237 | 100 | 16.158 | 44.673 | 83 |
| C1080.c03 | CRF01_AE | 0.279 | 1.757 | 100 | 0.162 | 1.452 | 100 | >50 | >50 | 50 |
| R2184.c04 | CRF01_AE | 0.020 | 0.047 | 100 | 0.034 | 0.120 | 100 | 3.376 | 11.753 | 100 |
| R1166.c01 | CRF01_AE | 0.267 | 0.852 | 100 | 0.060 | 0.336 | 100 | 19.190 | >50 | 78 |
| R3265.c06 | CRF01_AE | 0.153 | 0.985 | 100 | 0.161 | 0.971 | 100 | 27.947 | >50 | 66 |
| C2101.c01 | CRF01_AE | 0.162 | 0.727 | 100 | 0.084 | 0.505 | 100 | 15.305 | 41.944 | 85 |
| C3347.c11 | CRF01_AE | 0.047 | 0.154 | 100 | 0.055 | 0.192 | 100 | 4.201 | 14.261 | 99 |
| C4118.c09 | CRF01_AE | 0.079 | 0.292 | 100 | 0.094 | 0.346 | 100 | 8.627 | 23.239 | 93 |
| CNE5 | CRF01_AE | 0.206 | 0.893 | 100 | | | | 19.516 | >50 | 72 |
| BJOX009000.02.4 | CRF01_AE | >50 | >50 | 43 | 2.841 | 10.644 | 100 | 0.418 | 1.428 | 100 |
| BJOX015000.11.5 | CRF01_AE (T/F) | 0.289 | 1.264 | 100 | 0.288 | 1.276 | 100 | 27.277 | >50 | 67 |
| BJOX010000.06.2 | CRF01_AE (T/F) | 0.267 | 1.111 | 100 | 6.810 | 21.831 | 100 | >50 | >50 | 39 |
| BJOX025000.01.1 | CRF01_AE (T/F) | 0.102 | 0.831 | 100 | 0.361 | 2.580 | 100 | 7.667 | 39.071 | 85 |
| BJOX028000.10.3 | CRF01_AE (T/F) | 0.322 | 1.491 | 100 | 5.330 | 46.666 | 100 | 34.001 | >50 | 64 |

TABLE 19-continued

Neutralization assay data of NS49 P7.2, NS49 P11, and NS49P18.1 mAbs against extended multiclade virus panel. mAbs tested at primary concentration of 50 ug/ml and titrated 5-fold 7x (duplicate wells).

| | | Titer in TZM.bl cells (ug/ml) | | | | | | | | |
|---|---|---|---|---|---|---|---|---|---|---|
| TABLE 19 | | N49P7.2 | | | NVS49 P11 | | | N49P18.1 | | |
| Virus ID | Clade* | IC50 | IC80 | MPI | IC50 | IC80 | MPI | IC50 | IC80 | MPI |
| X1193_c1 | G | 0.014 | 0.101 | 100 | 0.179 | 1.086 | 100 | 3.121 | 23.883 | 94 |
| P0402_c2_11 | G | 0.106 | 0.400 | 100 | 0.091 | 0.698 | 100 | 5.470 | 20.782 | 98 |
| X1254_c3 | G | 27.526 | >50 | 53 | 5.987 | 20.682 | 100 | 24.797 | >50 | 61 |
| X2088_c9 | G | 0.377 | 2.030 | 99 | 6.816 | 21.955 | 100 | 9.084 | 34.895 | 88 |
| X2131_C1_B5 | G | 0.161 | 0.671 | 100 | 5.364 | 18.369 | 100 | 30.361 | >50 | 75 |
| P1981_C5_3 | G | 0.258 | 0.716 | 100 | 5.293 | 16.523 | 100 | 19.315 | 45.400 | 83 |
| X1632_S2_B10 | G | >50 | >50 | 22 | 9.727 | 26.077 | 100 | >50 | >50 | 19 |
| 3016.v5.c45 | D | 2.765 | 23.879 | 90 | 8.749 | 21.450 | 100 | >50 | >50 | 49 |
| A07412M1.vrc12 | D | 0.768 | 2.319 | 100 | 2.517 | 12.862 | 100 | 41.253 | >50 | 54 |
| 231965.c01 | D | 0.316 | 1.063 | 100 | 9.778 | 24.225 | 100 | >50 | >50 | 31 |
| 231966.c02 | D | 0.233 | 1.110 | 100 | 4.308 | 15.953 | 100 | 29.943 | >50 | 67 |
| 3817.v2.c59 | CD | 9.833 | >50 | 68 | 4.724 | 15.901 | 100 | >50 | >50 | 34 |
| 6480.v4.c25 | CD | 0.098 | 0.371 | 100 | 0.227 | 1.032 | 100 | 2.968 | 17.293 | 99 |
| 6952.v1.c20 | CD | >50 | >50 | 0 | 6.569 | 22.666 | 100 | >50 | >50 | 30 |
| 6811.v7.c18 | CD | 0.541 | 2.550 | 100 | 3.677 | 14.637 | 100 | 7.427 | 31.872 | 94 |
| 89-F1_2_25 | CD | >50 | >50 | 18 | 4.237 | 16.633 | 100 | >50 | >50 | 9 |
| 3301.v1.c24 | AC | 0.050 | 0.137 | 100 | 1.978 | 15.720 | 100 | 3.247 | 11.319 | 99 |
| 6041.v3.c23 | AC | 0.309 | 5.114 | 94 | 4.422 | 17.592 | 100 | 3.050 | 12.169 | 96 |
| 6540.v4.c1 | AC | >50 | >50 | 33 | 3.052 | 16.320 | 100 | >50 | >50 | 35 |
| 6545.v4.c1 | AC | >50 | >50 | 4 | 6.471 | 22.906 | 100 | >50 | >50 | 0 |
| 0815.v3.c3 | ACD | 0.023 | 0.103 | 100 | 0.106 | 0.372 | 100 | 0.741 | 8.454 | 99 |
| 3103.v3.c10 | ACD | 0.222 | 0.570 | 100 | 12.621 | 26.396 | 100 | 8.561 | 32.418 | 93 |
| MuLV | Neg. Control | >50 | >50 | 4 | | | | >50 | >50 | 0 |

*(T/F): Transmitted/Founder Virus

TABLE 20

Neutralization assay data of N49 P19, NVS49 P9, and NVS49 P9.1 mAbs against extended multiclade virus panel. mAbs tested at primary concentration of 50 ug/ml and titrated 5-fold 7x (duplicate wells).

| | | Titer in TZM.bl cells (ug/ml) | | | | | | | | |
|---|---|---|---|---|---|---|---|---|---|---|
| | | N49P19 | | | NVS49 P9 | | | NVS49 P9.1 | | |
| Virus ID | Clade* | IC50 | IC80 | MPI | IC50 | IC80 | MPI | IC50 | IC80 | MPI |
| 6535.3 | B | 9.091 | 28.290 | 95 | 0.552 | 2.256 | 100 | 0.232 | 2.062 | 100 |
| QH0692.42 | B | 2.560 | 13.420 | 98 | 0.352 | 1.210 | 100 | 0.107 | 0.709 | 100 |
| SC422661.8 | B | 0.425 | 1.415 | 100 | 0.241 | 0.691 | 100 | 0.127 | 0.468 | 100 |
| PVO.4 | B | 0.850 | 2.946 | 100 | 0.179 | 0.628 | 100 | 0.181 | 0.874 | 100 |
| TRO.11 | B | 0.394 | 1.301 | 100 | 0.044 | 0.177 | 100 | 0.052 | 0.196 | 100 |
| AC10.0.29 | B | >50 | >50 | 13 | 0.285 | 0.986 | 100 | 0.360 | 1.877 | 99 |
| RHPA4259.7 | B | >50 | >50 | 42 | 0.023 | 0.078 | 100 | 0.021 | 0.066 | 100 |
| THRO4156.18 | B | 17.077 | >50 | 69 | 1.407 | 8.213 | 99 | 1.650 | 9.443 | 99 |
| REJO4541.67 | B | 0.169 | 0.859 | 100 | 0.071 | 0.291 | 100 | 0.064 | 0.231 | 100 |
| TRJO4551.58 | B | 1.230 | 5.404 | 99 | 0.036 | 0.128 | 100 | 0.035 | 0.120 | 100 |
| WITO4160.33 | B | 0.263 | 1.291 | 100 | 0.058 | 0.165 | 100 | 0.051 | 0.241 | 100 |
| CAAN5342.A2 | B | 1.241 | 4.402 | 100 | 2.091 | 7.380 | 100 | 2.160 | 8.001 | 99 |
| WEAU_d15_410_787 | B (T/F) | 0.177 | 0.612 | 100 | 0.063 | 0.162 | 100 | 0.068 | 0.253 | 100 |
| 1006_11_C3_1601 | B (T/F) | 0.400 | 1.330 | 100 | 0.076 | 0.231 | 100 | 0.135 | 0.448 | 100 |
| 1054_07_TC4_1499 | B (T/F) | 2.854 | 11.746 | 99 | 0.885 | 2.445 | 100 | 1.798 | 7.198 | 100 |
| 1056_10_TA11_1826 | B (T/F) | 0.925 | 3.154 | 100 | 0.386 | 1.325 | 100 | 0.617 | 3.028 | 100 |
| 1012_11_TC21_3257 | B (T/F) | 0.204 | 0.895 | 100 | 0.194 | 0.591 | 100 | 0.382 | 1.448 | 100 |
| 6240_08_TA5_4622 | B (T/F) | 2.102 | 7.516 | 100 | 0.308 | 1.259 | 100 | 0.716 | 2.552 | 100 |
| 6244_13_B5_4576 | B (T/F) | 0.571 | 1.818 | 100 | 0.132 | 0.366 | 100 | 0.343 | 1.504 | 100 |
| 62357_14_D3_4589 | B (T/F) | 37.353 | >50 | 51 | 0.074 | 0.307 | 100 | 0.227 | 1.086 | 99 |
| SC05_8C11_2344 | B (T/F) | 0.954 | 3.296 | 100 | 0.473 | 1.608 | 100 | 1.302 | 4.392 | 100 |
| Du156.12 | C | 2.175 | 17.013 | 87 | 0.043 | 0.130 | 100 | 0.066 | 0.252 | 100 |
| Du172.17 | C | >50 | >50 | 30 | 0.023 | 0.178 | 100 | 0.026 | 0.182 | 100 |
| Du422.1 | C | >50 | >50 | 30 | >50 | >50 | 17 | >50 | >50 | 17 |
| ZM197M.PB7 | C | 38.389 | >50 | 56 | 0.083 | 0.339 | 100 | 0.049 | 0.283 | 100 |
| ZM214M.PL15 | C | 1.850 | 14.820 | 98 | 0.477 | 1.989 | 100 | 0.561 | 2.963 | 100 |
| ZM233M.PB6 | C | >50 | >50 | 4 | >50 | >50 | 48 | >50 | >50 | 6 |
| ZM249M.PL1 | C | >50 | >50 | 33 | 0.152 | 0.801 | 97 | 0.206 | 1.916 | 95 |
| ZM53M.PB12 | C | 1.187 | 4.143 | 100 | 0.362 | 1.137 | 100 | 0.447 | 1.287 | 100 |
| ZM109F.PB4 | C | 0.282 | 2.660 | 92 | 0.075 | 0.349 | 99 | 0.116 | 0.497 | 95 |
| ZM135M.PL10a | C | >50 | >50 | 0 | 0.224 | 0.863 | 97 | 0.332 | 1.529 | 98 |

TABLE 20-continued

Neutralization assay data of N49 P19, NVS49 P9, and NVS49 P9.1 mAbs against extended multiclade virus panel. mAbs tested at primary concentration of 50 ug/ml and titrated 5-fold 7× (duplicate wells).

| | | Titer in TZM.bl cells (ug/ml) | | | | | | | | |
|---|---|---|---|---|---|---|---|---|---|---|
| | | N49P19 | | | NVS49 P9 | | | NVS49 P9.1 | | |
| Virus ID | Clade* | IC50 | IC80 | MPI | IC50 | IC80 | MPI | IC50 | IC80 | MPI |
| CAP45.2.00.G3 | C | >50 | >50 | 5 | 0.294 | 1.986 | 98 | 1.722 | 19.580 | 88 |
| CAP210.2.00.E8 | C | >50 | >50 | 0 | >50 | >50 | 32 | >50 | >50 | 2 |
| HIV-001428-2.42 | C | >50 | >50 | 44 | 0.022 | 0.106 | 99 | 0.037 | 0.120 | 99 |
| HIV-0013095-2.11 | C | >50 | >50 | 18 | 0.179 | 0.635 | 100 | 0.358 | 1.262 | 100 |
| HIV-16055-2.3 | C | >50 | >50 | 30 | 0.077 | 0.274 | 100 | 0.102 | 0.362 | 100 |
| HIV-16845-2.22 | C | 14.499 | >50 | 73 | 1.090 | 9.957 | 98 | 2.131 | 10.747 | 98 |
| Ce1086_B2 | C (T/F) | 0.613 | 2.680 | 97 | 0.341 | 1.687 | 97 | 0.814 | 4.077 | 96 |
| Ce0393_C3 | C (T/F) | >50 | >50 | 31 | 0.189 | 0.595 | 100 | 0.284 | 1.221 | 100 |
| Ce1176_A3 | C (T/F) | 1.567 | 9.839 | 99 | 0.258 | 0.919 | 100 | 0.440 | 0.998 | 100 |
| Ce2010_F5 | C (T/F) | 7.660 | 45.381 | 82 | 0.089 | 0.271 | 100 | 0.120 | 0.380 | 100 |
| Ce0682_E4 | C (T/F) | 0.607 | 2.323 | 98 | 0.049 | 0.185 | 100 | 0.076 | 0.264 | 100 |
| Ce1172_H1 | C (T/F) | >50 | >50 | 3 | 8.796 | >50 | 70 | >50 | >50 | 42 |
| Ce2060_G9 | C (T/F) | 1.056 | 5.615 | 98 | 0.419 | 2.190 | 100 | 0.781 | 3.540 | 100 |
| Ce703010054_2A2 | C (T/F) | >50 | >50 | 0 | 0.187 | 0.898 | 98 | 0.433 | 3.177 | 96 |
| BF1266.431a | C (T/F) | >50 | >50 | 15 | 0.154 | 0.519 | 99 | 0.808 | 3.142 | 95 |
| 246F C1G | C (T/F) | >50 | >50 | 19 | >50 | >50 | 48 | >50 | >50 | 11 |
| 249M B10 | C (T/F) | >50 | >50 | 39 | 0.203 | 1.411 | 97 | 0.305 | 1.644 | 96 |
| ZM247v1(Rev-) | C (T/F) | >50 | >50 | 5 | 0.622 | 3.301 | 100 | 1.878 | 17.837 | 87 |
| 7030102001E5(Rev-) | C (T/F) | 0.950 | 4.701 | 100 | 0.453 | 2.028 | 100 | 0.635 | 2.016 | 100 |
| 1394C9G1(Rev-) | C (T/F) | >50 | >50 | 17 | >50 | >50 | 40 | >50 | >50 | 6 |
| Ce704809221_1B3 | C (T/F) | 3.746 | 19.191 | 93 | 0.133 | 0.605 | 100 | 0.162 | 0.661 | 100 |
| CNE19 | BC | 20.710 | >50 | 59 | 0.031 | 0.136 | 100 | 0.033 | 0.146 | 100 |
| CNE20 | BC | 0.124 | 0.817 | 99 | 0.465 | 2.432 | 97 | 1.514 | 16.392 | 90 |
| CNE21 | BC | >50 | >50 | 21 | >50 | >50 | 36 | >50 | >50 | 15 |
| CNE17 | BC | >50 | >50 | 30 | 0.364 | 1.699 | 100 | 0.251 | 1.231 | 100 |
| CNE30 | BC | 1.269 | 4.275 | 100 | 0.259 | 0.693 | 100 | 0.271 | 0.971 | 100 |
| CNE52 | BC | 0.175 | 0.491 | 100 | 0.026 | 0.090 | 100 | 0.043 | 0.122 | 100 |
| CNE53 | BC | 1.501 | >50 | 78 | 0.123 | 0.462 | 99 | 0.140 | 0.647 | 99 |
| CNE58 | BC | >50 | >50 | 43 | 0.030 | 0.081 | 100 | 0.027 | 0.074 | 100 |
| MS208.A1 | A | 0.501 | 1.987 | 99 | 0.080 | 0.294 | 100 | 0.082 | 0.248 | 100 |
| Q23.17 | A | 0.234 | 1.368 | 100 | 0.032 | 0.091 | 100 | 0.029 | 0.106 | 100 |
| Q461.e2 | A | 0.774 | 4.053 | 100 | 0.271 | 0.953 | 100 | 0.363 | 1.146 | 100 |
| Q769.d22 | A | 0.140 | 0.519 | 100 | 0.036 | 0.123 | 100 | 0.039 | 0.148 | 100 |
| Q259.d2.17 | A | >50 | >50 | 11 | 0.807 | >50 | 74 | >50 | >50 | 48 |
| Q842.d12 | A | 0.182 | 0.601 | 100 | 0.019 | 0.057 | 100 | 0.027 | 0.075 | 100 |
| 3415.v1.c1 | A | 0.462 | 2.038 | 100 | 0.137 | 0.502 | 100 | 0.210 | 1.372 | 100 |
| 3365.v2.c2 | A | 0.579 | 2.091 | 99 | 0.059 | 0.198 | 100 | 0.055 | 0.725 | 100 |
| 0260.v5.c36 | A | 1.250 | 8.524 | 99 | 0.466 | 1.852 | 100 | 0.519 | 0.151 | 100 |
| 191955_A11 | A (T/F) | >50 | >50 | 16 | >50 | >50 | 35 | >50 | >50 | 26 |
| 191084 B7-19 | A (T/F) | 0.357 | 1.340 | 100 | 0.042 | 0.129 | 100 | 0.097 | 0.259 | 100 |
| 9004SS_A3_4 | A (T/F) | 0.661 | 3.086 | 100 | 0.175 | 0.751 | 100 | 0.323 | 1.129 | 100 |
| T257-31 | CRF02_AG | 0.661 | 2.995 | 100 | 0.216 | 0.821 | 100 | 0.508 | 1.819 | 100 |
| 928-28 | CRF02_AG | 2.726 | 9.630 | 97 | 0.094 | 0.339 | 100 | 0.163 | 0.695 | 100 |
| 263-8 | CRF02_AG | 0.344 | 1.510 | 99 | 0.032 | 0.161 | 100 | 0.049 | 0.170 | 100 |
| T250-4 | CRF02_AG | >50 | >50 | 7 | >50 | >50 | 25 | >50 | >50 | 7 |
| T251-18 | CRF02_AG | 0.938 | 4.204 | 100 | 0.147 | 0.517 | 100 | 0.127 | 0.352 | 100 |
| T278-50 | CRF02_AG | >50 | >50 | 35 | >50 | >50 | 25 | >50 | >50 | 5 |
| T255-34 | CRF02_AG | 0.948 | 6.223 | 97 | 0.051 | 0.247 | 100 | 0.092 | 0.286 | 100 |
| 211-9 | CRF02_AG | 3.230 | 18.983 | 93 | 0.136 | 0.485 | 100 | 0.170 | 0.579 | 100 |
| 235-47 | CRF02_AG | 0.440 | 3.227 | 89 | 0.072 | 0.271 | 98 | 0.045 | 0.352 | 98 |
| 620345.c01 | CRF01_AE | >50 | >50 | 0 | >50 | >50 | 9 | >50 | >50 | 7 |
| CNE8 | CRF01_AE | 0.772 | 4.840 | 97 | 0.056 | 0.260 | 100 | 0.228 | 0.921 | 100 |
| C1080.c03 | CRF01_AE | 0.682 | 3.053 | 100 | 0.119 | 0.575 | 100 | 0.156 | 0.939 | 100 |
| R2184.c04 | CRF01_AE | 0.132 | 0.445 | 100 | 0.015 | 0.034 | 100 | 0.019 | 0.057 | 100 |
| R1166.c01 | CRF01_AE | 0.629 | 2.693 | 100 | 0.064 | 0.223 | 100 | 0.073 | 0.232 | 100 |
| R3265.c06 | CRF01_AE | 0.634 | 2.735 | 100 | 0.135 | 0.812 | 100 | 0.469 | 1.621 | 100 |
| C2101.c01 | CRF01_AE | 0.978 | 4.192 | 100 | 0.051 | 0.209 | 100 | 0.085 | 0.227 | 100 |
| C3347.c11 | CRF01_AE | 3.943 | 25.715 | 87 | 0.023 | 0.065 | 100 | 0.029 | 0.083 | 100 |
| C4118.c09 | CRF01_AE | 0.386 | 1.361 | 100 | 0.072 | 0.200 | 100 | 0.062 | 0.218 | 100 |
| CNE5 | CRF01_AE | 0.748 | 3.290 | 100 | | | | 0.183 | 0.641 | 100 |
| BJOX009000.02.4 | CRF01_AE | 3.664 | 25.579 | 87 | 0.727 | 3.293 | 100 | 0.965 | 3.934 | 100 |
| BJOX015000.11.5 | CRF01_AE (T/F) | 0.756 | 3.165 | 99 | 0.089 | 0.375 | 100 | 0.068 | 0.478 | 100 |
| BJOX010000.06.2 | CRF01_AE (T/F) | 4.159 | 19.069 | 96 | 0.482 | 2.337 | 100 | 0.883 | 4.259 | 100 |
| BJOX025000.01.1 | CRF01_AE (T/F) | >50 | >50 | 24 | 0.055 | 0.252 | 100 | 0.131 | 0.670 | 100 |
| BJOX028000.10.3 | CRF01_AE (T/F) | 6.996 | >50 | 80 | 0.031 | 0.134 | 100 | 0.040 | 0.200 | 100 |
| X1193_c1 | G | 0.540 | 3.147 | 99 | 0.025 | 0.081 | 100 | 0.042 | 0.150 | 100 |

TABLE 20-continued

Neutralization assay data of N49 P19, NVS49 P9, and NVS49 P9.1 mAbs against extended multiclade virus panel. mAbs tested at primary concentration of 50 ug/ml and titrated 5-fold 7× (duplicate wells).

| | | Titer in TZM.bl cells (ug/ml) | | | | | | | | |
|---|---|---|---|---|---|---|---|---|---|---|
| | | N49P19 | | | NVS49 P9 | | | NVS49 P9.1 | | |
| Virus ID | Clade* | IC50 | IC80 | MPI | IC50 | IC80 | MPI | IC50 | IC80 | MPI |
| P0402_c2_11 | G | 0.448 | 2.630 | 100 | 0.028 | 0.085 | 100 | 0.060 | 0.163 | 100 |
| X1254_c3 | G | >50 | >50 | 48 | 0.040 | 0.104 | 100 | 0.101 | 0.278 | 100 |
| X2088_c9 | G | 1.402 | 3.760 | 99 | 0.070 | 0.252 | 100 | 0.091 | 0.392 | 100 |
| X2131_C1_B5 | G | 2.522 | 14.446 | 91 | 0.082 | 0.274 | 100 | 0.143 | 0.476 | 100 |
| P1981_C5_3 | G | 20.237 | >50 | 68 | 0.308 | 0.701 | 100 | 0.469 | 1.523 | 100 |
| X1632_S2_B10 | G | >50 | >50 | 14 | 46.721 | >50 | 51 | >50 | >50 | 10 |
| 3016.v5.c45 | D | >50 | >50 | 9 | 0.060 | 0.209 | 100 | 0.076 | 0.223 | 100 |
| A07412M1.vrc12 | D | 3.892 | 48.832 | 80 | 0.142 | 0.636 | 100 | 0.189 | 0.947 | 100 |
| 231965.c01 | D | >50 | >50 | 22 | 0.253 | 1.159 | 100 | 0.474 | 2.239 | 100 |
| 231966.c02 | D | 0.653 | 4.553 | 100 | 0.074 | 0.244 | 100 | 0.067 | 0.237 | 100 |
| 3817.v2.c59 | CD | >50 | >50 | 26 | 1.092 | 5.859 | 100 | 1.347 | 8.262 | 95 |
| 6480.v4.c25 | CD | 3.035 | 28.156 | 87 | 0.017 | 0.047 | 100 | 0.030 | 0.082 | 100 |
| 6952.v1.c20 | CD | >50 | >50 | 0 | 0.095 | 0.258 | 100 | 0.119 | 0.389 | 100 |
| 6811.v7.c18 | CD | 1.305 | 4.709 | 97 | 0.249 | 1.195 | 99 | 0.398 | 1.757 | 97 |
| 89-F1_2_25 | CD | >50 | >50 | 7 | >50 | >50 | 23 | >50 | >50 | 23 |
| 3301.v1.c24 | AC | 0.302 | 1.423 | 98 | 0.072 | 0.246 | 100 | 0.059 | 0.178 | 100 |
| 6041.v3.c23 | AC | >50 | >50 | 32 | 0.089 | 0.777 | 95 | 0.282 | 6.781 | 90 |
| 6540.v4.c1 | AC | 11.229 | >50 | 63 | >50 | >50 | 49 | >50 | >50 | 30 |
| 6545.v4.c1 | AC | >50 | >50 | 2 | >50 | >50 | 20 | >50 | >50 | 6 |
| 0815.v3.c3 | ACD | 0.176 | 0.743 | 100 | 0.020 | 0.057 | 100 | 0.012 | 0.041 | 100 |
| 3103.v3.c10 | ACD | >50 | >50 | 0 | 17.571 | >50 | 55 | >50 | >50 | 45 |
| MuLV | Neg. Control | >50 | >50 | 0 | >50 | >50 | 13 | | 21.396 | 22.133 |

*(T/F): Transmitted/Founder Virus

TABLE 21

Neutralization assay data of N49 P23, N40P22, and PGT121 mAbs against extended multiclade virus panel. mAbs tested at primary concentration of 50 ug/ml and titrated 5-fold 7× (duplicate wells).

| | | Titer in TZM.bl cells (ug/ml) | | | | | | | |
|---|---|---|---|---|---|---|---|---|---|
| | | N49P23 | | | N49P22 | | | PGT121 | |
| Virus ID | Clade* | IC50 | IC80 | MPI | IC50 | IC80 | MPI | IC50 | IC80 |
| 6535.3 | B | 0.127 | 0.855 | 100 | >50 | >50 | 5 | 0.002 | 0.008 |
| QH0692.42 | B | 0.557 | 2.513 | 100 | 0.592 | 2.024 | 100 | 0.302 | 2.314 |
| SC422661.8 | B | 0.069 | 0.245 | 100 | 0.120 | 0.544 | 100 | 0.038 | 0.177 |
| PVO.4 | B | 0.087 | 0.430 | 100 | 0.433 | 1.492 | 100 | 0.098 | 0.343 |
| TRO.11 | B | 0.094 | 0.336 | 100 | 0.283 | 1.365 | 99 | 0.005 | 0.025 |
| AC10.0.29 | B | >50 | >50 | 0 | >50 | >50 | 0 | 0.024 | 0.073 |
| RHPA4259.7 | B | 0.010 | 0.040 | 100 | 0.637 | 5.596 | 92 | 0.015 | 0.035 |
| THRO4156.18 | B | 1.979 | 10.746 | 97 | >50 | >50 | 32 | >50 | >50 |
| REJO4541.67 | B | 0.008 | 0.050 | 100 | 0.792 | 12.089 | 84 | 4.774 | >50 |
| TRJO4551.58 | B | 0.016 | 0.068 | 100 | >50 | >50 | 28 | 1.314 | 37.88 |
| WITO4160.33 | B | 0.045 | 0.205 | 100 | 4.862 | >50 | 74 | 0.334 | 2.351 |
| CAAN5342.A2 | B | 0.412 | 1.381 | 100 | 0.425 | 1.884 | 99 | 0.007 | 0.023 |
| WEAU_d15_410_787 | B (T/F) | 0.009 | 0.031 | 100 | 1.541 | >50 | 76 | 0.026 | 0.077 |
| 1006_11_C3_1601 | B (T/F) | 0.015 | 0.054 | 100 | 0.898 | 14.693 | 83 | 0.002 | 0.007 |
| 1054_07_TC4_1499 | B (T/F) | 0.272 | 1.211 | 100 | 0.654 | 2.893 | 100 | 0.064 | 0.304 |
| 1056_10_TA11_1826 | B (T/F) | 0.075 | 0.483 | 100 | 2.991 | >50 | 69 | 0.004 | 0.081 |
| 1012_11_TC21_3257 | B (T/F) | 0.013 | 0.085 | 100 | 15.726 | >50 | 53 | 0.003 | 0.017 |
| 6240_08_TA5_4622 | B (T/F) | 0.215 | 1.000 | 100 | 2.330 | 9.760 | 93 | 0.033 | 0.127 |
| 6244_13_B5_4576 | B (T/F) | 0.151 | 0.570 | 100 | 0.565 | 2.482 | 97 | 0.061 | 0.347 |
| 62357_14_D3_4589 | B (T/F) | 0.057 | 0.760 | 95 | >50 | >50 | 13 | 2.597 | >50 |
| SC05_8C11_2344 | B (T/F) | 0.133 | 0.548 | 100 | 0.251 | 2.159 | 97 | 0.019 | 0.071 |
| Du156.12 | C | >50 | >50 | 0 | >50 | >50 | 4 | 0.004 | 0.017 |
| Du172.17 | C | >50 | >50 | 45 | >50 | >50 | 4 | 0.033 | 0.257 |
| Du422.1 | C | >50 | >50 | 4 | >50 | >50 | 4 | 0.039 | 0.143 |
| ZM197M.PB7 | C | 0.100 | 0.385 | 100 | 2.583 | 25.090 | 84 | >50 | >50 |
| ZM214M.PL15 | C | 0.061 | 0.614 | 100 | >50 | >50 | 25 | 0.460 | 2.039 |
| ZM233M.PB6 | C | >50 | >50 | 14 | >50 | >50 | 2 | 3.689 | ##### |
| ZM249M.PL1 | C | >50 | >50 | 2 | >50 | >50 | 0 | >50 | >50 |
| ZM53M.PB12 | C | 0.135 | 0.651 | 100 | 1.197 | 11.765 | 91 | <0.001 | 0.004 |
| ZM109F.PB4 | C | 0.039 | 0.180 | 100 | >50 | >50 | 1 | 8.639 | >50 |
| ZM135M.PL10a | C | >50 | >50 | 36 | >50 | >50 | 27 | 0.716 | 5.246 |

TABLE 21-continued

Neutralization assay data of N49 P23, N40P22, and PGT121 mAbs against extended multiclade virus panel. mAbs tested at primary concentration of 50 ug/ml and titrated 5-fold 7× (duplicate wells).

| | | Titer in TZM.bl cells (ug/ml) | | | | | | | |
|---|---|---|---|---|---|---|---|---|---|
| | | N49P23 | | | N49P22 | | | PGT121 | |
| Virus ID | Clade* | IC50 | IC80 | MPI | IC50 | IC80 | MPI | IC50 | IC80 |
| CAP45.2.00.G3 | C | >50 | >50 | 0 | >50 | >50 | 0 | 1.634 | >50 |
| CAP210.2.00.E8 | C | >50 | >50 | 2 | >50 | >50 | 6 | 26.301 | >50 |
| HIV-001428-2.42 | C | 0.036 | 0.241 | 98 | 0.730 | 7.097 | 91 | 0.014 | 0.051 |
| HIV-0013095-2.11 | C | 0.114 | 0.899 | 96 | >50 | >50 | 9 | >50 | >50 |
| HIV-16055-2.3 | C | >50 | >50 | 17 | 4.655 | 39.690 | 83 | 0.153 | 4.804 |
| HIV-16845-2.22 | C | >50 | >50 | 20 | 4.600 | 41.933 | 87 | 3.969 | 44.570 |
| Ce1086_B2 | C (T/F) | 0.063 | 0.303 | 100 | >50 | >50 | 0 | <0.001 | <0.001 |
| Ce0393_C3 | C (T/F) | >50 | >50 | 29 | >50 | >50 | 12 | >50 | >50 |
| Ce1176_A3 | C (T/F) | 0.297 | 1.384 | 100 | >50 | >50 | 23 | 0.013 | 0.035 |
| Ce2010_F5 | C (T/F) | 1.590 | 11.612 | 91 | 2.053 | 11.680 | 93 | >50 | >50 |
| Ce0682_E4 | C (T/F) | 1.391 | >50 | 76 | 1.132 | >50 | 75 | >50 | >50 |
| Ce1172_H1 | C (T/F) | >50 | >50 | 0 | >50 | >50 | 0 | 0.011 | 0.036 |
| Ce2060_G9 | C (T/F) | 0.180 | 0.849 | 99 | >50 | >50 | 19 | >50 | >50 |
| Ce703010054_2A2 | C (T/F) | >50 | >50 | 35 | >50 | >50 | 0 | >50 | >50 |
| BF1266.431a | C (T/F) | 0.083 | 0.440 | 99 | >50 | >50 | 0 | >50 | >50 |
| 246F C1G | C (T/F) | >50 | >50 | 11 | >50 | >50 | 10 | 0.041 | 0.140 |
| 249M B10 | C (T/F) | >50 | >50 | 20 | >50 | >50 | 4 | >50 | >50 |
| ZM247v1(Rev-) | C (T/F) | >50 | >50 | 24 | >50 | >50 | 11 | 0.028 | 0.082 |
| 7030102001E5(Rev-) | C (T/F) | 0.172 | 0.797 | 100 | >50 | >50 | 21 | 0.009 | 0.027 |
| 1394C9G1(Rev-) | C (T/F) | >50 | >50 | 34 | >50 | >50 | 35 | 0.264 | 1.948 |
| Ce704809221_1B3 | C (T/F) | 0.083 | 0.643 | 100 | 15.799 | >50 | 60 | 0.025 | 0.126 |
| CNE19 | BC | >50 | >50 | 40 | 0.873 | 8.185 | 92 | 0.008 | 0.105 |
| CNE20 | BC | 45.443 | >50 | 51 | >50 | >50 | 18 | <0.001 | 0.002 |
| CNE21 | BC | >50 | >50 | 0 | >50 | >50 | 0 | 0.007 | 0.035 |
| CNE17 | BC | 0.221 | 0.809 | 100 | 46.299 | >50 | 53 | 7.600 | >50 |
| CNE30 | BC | 0.143 | 0.680 | 100 | >50 | >50 | 30 | 0.078 | 0.291 |
| CNE52 | BC | 0.014 | 0.051 | 100 | 1.701 | 10.016 | 91 | 2.045 | 18.929 |
| CNE53 | BC | 0.026 | 0.095 | 100 | 0.779 | 5.111 | 93 | 0.007 | 0.024 |
| CNE58 | BC | >50 | >50 | 9 | 28.372 | >50 | 57 | >50 | >50 |
| MS208.A1 | A | 0.048 | 0.279 | 100 | >50 | >50 | 17 | >50 | >50 |
| Q23.17 | A | 0.010 | 0.046 | 100 | 0.321 | 2.400 | 96 | <0.001 | 0.005 |
| Q461.e2 | A | 0.099 | 0.464 | 100 | 11.157 | >50 | 66 | >50 | >50 |
| Q769.d22 | A | 0.005 | 0.025 | 100 | 0.043 | 0.259 | 100 | >50 | >50 |
| Q259.d2.17 | A | 0.362 | 7.795 | 91 | >50 | >50 | 15 | 15.379 | >50 |
| Q842.d12 | A | 0.007 | 0.022 | 100 | 0.079 | 0.359 | 100 | 0.005 | 0.022 |
| 3415.v1.c1 | A | 0.054 | 0.190 | 100 | 0.198 | 1.410 | 96 | NT | NT |
| 3365.v2.c2 | A | 0.017 | 0.053 | 100 | 0.254 | 0.857 | 98 | NT | NT |
| 0260.v5.c36 | A | 0.261 | 0.919 | 100 | 1.673 | 14.382 | 93 | 0.053 | 0.197 |
| 191955_A11 | A (T/F) | >50 | >50 | 31 | >50 | >50 | 9 | >50 | >50 |
| 191084 B7-19 | A (T/F) | 0.013 | 0.043 | 100 | 0.343 | 1.639 | 98 | 0.011 | 0.032 |
| 9004SS_A3_4 | A (T/F) | 0.043 | 0.223 | 100 | >50 | >50 | 42 | <0.001 | 0.003 |
| T257-31 | CRF02_AG | 0.178 | 1.167 | 100 | >50 | >50 | 43 | >50 | >50 |
| 928-28 | CRF02_AG | 0.021 | 0.122 | 100 | >50 | >50 | 32 | 44.189 | >50 |
| 263-8 | CRF02_AG | 0.012 | 0.096 | 100 | 1.829 | 18.462 | 89 | 0.648 | 3.961 |
| T250-4 | CRF02_AG | >50 | >50 | 0 | >50 | >50 | 5 | <0.001 | 0.005 |
| T251-18 | CRF02_AG | >50 | >50 | 18 | 0.580 | 3.092 | 99 | 29.016 | >50 |
| T278-50 | CRF02_AG | >50 | >50 | 22 | >50 | >50 | 25 | >50 | >50 |
| T255-34 | CRF02_AG | >50 | >50 | 20 | 38.766 | >50 | 55 | 18.695 | >50 |
| 211-9 | CRF02_AG | >50 | >50 | 14 | >50 | >50 | 18 | 0.852 | 4.202 |
| 235-47 | CRF02_AG | 0.085 | 0.749 | 90 | 0.037 | 0.373 | 99 | 0.137 | 0.727 |
| 620345.c01 | CRF01_AE | >50 | >50 | 0 | >50 | >50 | 0 | >50 | >50 |
| CNE8 | CRF01_AE | 6.353 | 47.322 | 81 | 5.350 | 40.442 | 86 | >50 | >50 |
| C1080.c03 | CRF01_AE | 1.328 | 11.328 | 96 | 15.863 | >50 | 64 | >50 | >50 |
| R2184.c04 | CRF01_AE | 0.008 | 0.032 | 100 | 0.077 | 0.342 | 100 | >50 | >50 |
| R1166.c01 | CRF01_AE | 0.123 | 0.455 | 100 | 0.232 | 0.799 | 100 | >50 | >50 |
| R3265.c06 | CRF01_AE | >50 | >50 | 0 | 3.575 | >50 | 67 | >50 | >50 |
| C2101.c01 | CRF01_AE | 0.056 | 0.362 | 100 | 0.171 | 1.059 | 99 | NT | NT |
| C3347.c11 | CRF01_AE | 0.007 | 0.032 | 100 | 1.181 | 12.263 | 89 | >50 | >50 |
| C4118.c09 | CRF01_AE | 0.026 | 0.120 | 100 | 1.821 | 26.577 | 93 | >50 | >50 |
| CNE5 | CRF01_AE | 0.058 | 0.226 | 100 | 0.281 | 1.553 | 96 | >50 | >50 |
| BJOX009000.02.4 | CRF01_AE | >50 | >50 | 8 | 17.324 | >50 | 64 | 2.858 | 31.728 |
| BJOX015000.11.5 | CRF01_AE (T/F) | >50 | >50 | 0 | 1.258 | 10.790 | 89 | >50 | >50 |
| BJOX010000.06.2 | CRF01_AE (T/F) | 0.284 | 2.078 | 100 | >50 | >50 | 0 | >50 | >50 |
| BJOX025000.01.1 | CRF01_AE (T/F) | >50 | >50 | 0 | >50 | >50 | 0 | >50 | >50 |
| BJOX028000.10.3 | CRF01_AE (T/F) | 0.021 | 0.123 | 98 | >50 | >50 | 0 | >50 | >50 |
| X1193_c1 | G | 0.008 | 0.038 | 100 | 3.492 | 28.543 | 85 | 0.016 | 0.086 |

TABLE 21-continued

Neutralization assay data of N49 P23, N40P22, and PGT121 mAbs against extended multiclade virus panel. mAbs tested at primary concentration of 50 ug/ml and titrated 5-fold 7× (duplicate wells).

| | | Titer in TZM.bl cells (ug/ml) | | | | | | | |
|---|---|---|---|---|---|---|---|---|---|
| | | N49P23 | | | N49P22 | | | PGT121 | |
| Virus ID | Clade* | IC50 | IC80 | MPI | IC50 | IC80 | MPI | IC50 | IC80 |
| P0402_c2_11 | G | 0.022 | 0.065 | 100 | 5.928 | >50 | 73 | 0.005 | 0.016 |
| X1254_c3 | G | 0.022 | 0.111 | 100 | 3.055 | 29.794 | 84 | 0.014 | 0.080 |
| X2088_c9 | G | >50 | >50 | 10 | >50 | >50 | 8 | 0.003 | 0.013 |
| X2131_C1_B5 | G | 0.080 | 0.280 | 100 | >50 | >50 | 44 | 0.004 | 0.023 |
| P1981_C5_3 | G | 0.096 | 0.264 | 100 | >50 | >50 | 48 | <0.001 | <0.001 |
| X1632_S2_B10 | G | 0.130 | >50 | 62 | >50 | >50 | 0 | >50 | >50 |
| 3016.v5.c45 | D | 0.027 | 0.092 | 100 | >50 | >50 | 23 | >50 | >50 |
| A07412M1.vrc12 | D | 0.114 | 0.830 | 97 | 9.600 | >50 | 63 | 0.009 | 0.075 |
| 231965.c01 | D | >50 | >50 | 35 | 2.044 | 35.200 | 83 | >50 | >50 |
| 231966.c02 | D | 0.035 | 0.158 | 100 | 3.351 | >50 | 69 | >50 | >50 |
| 3817.v2.c59 | CD | >50 | >50 | 41 | >50 | >50 | 12 | 18.888 | >50 |
| 6480.v4.c25 | CD | >50 | >50 | 29 | 0.809 | 32.124 | 86 | <0.001 | 0.004 |
| 6952.v1.c20 | CD | 0.007 | 0.023 | 100 | 33.248 | >50 | 56 | 0.056 | 0.420 |
| 6811.v7.c18 | CD | 17.656 | >50 | 61 | 1.003 | 9.719 | 92 | <0.001 | 0.001 |
| 89-F1_2_25 | CD | >50 | >50 | 5 | >50 | >50 | 10 | >50 | >50 |
| 3301.v1.c24 | AC | 0.017 | 0.058 | 100 | 2.819 | 48.778 | 80 | 0.008 | 0.019 |
| 6041.v3.c23 | AC | 7.466 | >50 | 63 | 7.547 | >50 | 66 | >50 | >50 |
| 6540.v4.c1 | AC | >50 | >50 | 29 | >50 | >50 | 29 | >50 | >50 |
| 6545.v4.c1 | AC | >50 | >50 | 10 | >50 | >50 | 17 | >50 | >50 |
| 0815.v3.c3 | ACD | 0.004 | 0.014 | 100 | 0.161 | 1.080 | 98 | 0.025 | 0.111 |
| 3103.v3.c10 | ACD | 43.751 | >50 | 54 | >50 | >50 | 16 | 0.009 | 0.028 |
| MuLV | Neg. Control | >50 | >50 | 9 | >50 | >50 | 8 | | |

*(T/F): Transmitted/Founder Virus

TABLE 22

Neutralization assay data of PGT128, PGT145, PGDM1400, and PGT151 mAbs against extended multiclade virus panel. mAbs tested at primary concentration of 50 ug/ml and titrated 5-fold 7× (duplicate wells).

| | | Titer in TZM.bl cells (ug/ml) | | | | | | | |
|---|---|---|---|---|---|---|---|---|---|
| | | PGT128 | | PGT145 | | PGDM1400 | | PGT151 | |
| Virus ID | Clade* | IC50 | IC80 | IC50 | IC80 | IC50 | IC80 | IC50 | IC80 |
| 6535.3 | B | 0.004 | 0.016 | >50 | >50 | >50 | >50 | <0.001 | 0.012 |
| QH0692.42 | B | 0.029 | 0.081 | >50 | >50 | >50 | >50 | 0.029 | 0.522 |
| SC422661.8 | B | 1.078 | 18.4 | 0.024 | 0.082 | 0.436 | 6.530 | 0.005 | 0.028 |
| PVO.4 | B | 0.011 | 0.028 | 0.192 | 0.870 | 0.484 | 6.487 | 0.017 | >50 |
| TRO.11 | B | 0.019 | 0.045 | 0.040 | 0.118 | 0.283 | 1.376 | >50 | >50 |
| AC10.0.29 | B | 0.008 | 0.018 | 0.010 | 0.025 | 0.105 | 0.869 | 0.007 | 0.023 |
| RHPA4259.7 | B | 0.026 | 0.109 | 0.029 | 0.095 | 0.447 | 2.194 | 0.006 | 0.033 |
| THRO4156.18 | B | >50 | >50 | 0.010 | 0.029 | 0.072 | 0.348 | >50 | >50 |
| REJO4541.67 | B | >50 | >50 | <0.001 | 0.001 | 0.028 | 0.992 | 0.018 | 0.119 |
| TRJO4551.58 | B | 0.018 | 0.041 | >50 | >50 | >50 | >50 | 0.496 | 4.217 |
| WITO4160.33 | B | >50 | >50 | <0.001 | 0.001 | <0.001 | 0.008 | 0.002 | 0.021 |
| CAAN5342.A2 | B | 0.514 | >50 | 6.675 | 25.524 | >50 | >50 | 0.005 | 0.038 |
| WEAU_d15_410_787 | B (T/F) | 0.032 | 0.153 | 1.951 | 31.540 | 0.103 | 1.366 | 0.010 | >50 |
| 1006_11_C3_1601 | B (T/F) | 0.011 | 0.040 | >50 | >50 | 4.318 | >50 | 2.891 | >50 |
| 1054_07_TC4_1499 | B (T/F) | 0.035 | 0.312 | >50 | >50 | >50 | >50 | 0.008 | 0.032 |
| 1056_10_TA11_1826 | B (T/F) | <0.001 | 0.008 | 0.230 | 0.938 | 3.258 | 11.840 | 0.008 | 0.048 |
| 1012_11_TC21_3257 | B (T/F) | 0.011 | 0.033 | 0.009 | 0.025 | 0.049 | 0.230 | >50 | >50 |
| 6240_08_TA5_4622 | B (T/F) | 0.019 | 0.055 | >50 | >50 | >50 | >50 | 0.046 | 0.420 |
| 6244_13_B5_4576 | B (T/F) | 0.020 | 0.076 | 7.266 | 44.473 | >50 | >50 | >50 | >50 |
| 62357_14_D3_4589 | B (T/F) | 1.144 | >50 | >50 | >50 | >50 | >50 | 0.004 | 0.023 |
| SC05_8C11_2344 | B (T/F) | 0.017 | 0.041 | 0.093 | 0.248 | 1.264 | 3.587 | 0.060 | >50 |
| Du156.12 | C | 0.017 | 0.046 | 0.001 | 0.018 | 0.002 | 0.008 | 0.005 | 0.023 |
| Du172.17 | C | 0.028 | 0.080 | >50 | >50 | 5.179 | 21.980 | 0.003 | 0.013 |
| Du422.1 | C | 0.039 | 0.113 | 22.564 | >50 | 0.694 | >50 | 4.604 | >50 |
| ZM197M.PB7 | C | >50 | >50 | 0.628 | 5.239 | 0.063 | 0.285 | 0.003 | 0.033 |
| ZM214M.PL15 | C | 1.498 | 29.44 | >50 | >50 | >50 | >50 | 0.008 | 0.045 |
| ZM233M.PB6 | C | >50 | >50 | 0.025 | 0.680 | <0.001 | 0.001 | 0.027 | 5.156 |
| ZM249M.PL1 | C | 39.66 | >50 | 1.442 | >50 | 0.016 | 0.701 | 0.004 | 0.015 |
| ZM53M.PB12 | C | >50 | >50 | 0.367 | 11.774 | 0.002 | 0.011 | >50 | >50 |
| ZM109F.PB4 | C | >50 | >50 | 0.042 | 0.234 | 0.057 | 0.382 | 0.609 | >50 |
| ZM135M.PL10a | C | >50 | >50 | >50 | >50 | >50 | >50 | >50 | >50 |

TABLE 22-continued

Neutralization assay data of PGT128, PGT145, PGDM1400, and PGT151 mAbs against extended multiclade virus panel. mAbs tested at primary concentration of 50 ug/ml and titrated 5-fold 7x (duplicate wells).

| | | Titer in TZM.bl cells (ug/ml) | | | | | | | |
|---|---|---|---|---|---|---|---|---|---|
| | | PGT128 | | PGT145 | | PGDM1400 | | PGT151 | |
| Virus ID | Clade* | IC50 | IC80 | IC50 | IC80 | IC50 | IC80 | IC50 | IC80 |
| CAP45.2.00.G3 | C | >50 | >50 | 0.001 | 0.007 | <0.001 | 0.002 | 0.007 | >50 |
| CAP210.2.00.E8 | C | >50 | >50 | 37.807 | >50 | 0.034 | 0.514 | 0.010 | 0.208 |
| HIV-001428-2.42 | C | 0.026 | 0.095 | 0.001 | 0.083 | <0.001 | 0.027 | 0.027 | >50 |
| HIV-0013095-2.11 | C | >50 | >50 | 9.271 | >50 | 0.003 | 0.012 | >50 | >50 |
| HIV-16055-2.3 | C | >50 | >50 | 0.003 | 0.051 | <0.001 | 0.003 | 0.143 | >50 |
| HIV-16845-2.22 | C | 0.181 | 0.834 | >50 | >50 | >50 >50 | >50 >50 | >50 | >50 |
| Ce1086_B2 | C (T/F) | >50 | >50 | >50 | >50 | >50 | >50 | 2.653 | >50 |
| Ce0393_C3 | C (T/F) | >50 | >50 | 0.112 | 1.225 | 0.015 | 0.044 | >50 | >50 |
| Ce1176_A3 | C (T/F) | 0.009 | 0.026 | >50 | >50 | 0.587 | 11.619 | 0.006 | 0.018 |
| Ce2010_F5 | C (T/F) | >50 | >50 | >50 | >50 | >50 | >50 | >50 | >50 |
| Ce0682_E4 | C (T/F) | >50 | >50 | 33.578 | >50 | 0.010 | 0.043 | >50 | >50 |
| Ce1172_H1 | C (T/F) | 0.013 | 0.038 | 0.260 | 2.062 | 0.021 | 0.060 | >50 | >50 |
| Ce2060_G9 | C (T/F) | >50 | >50 | 0.016 | 0.205 | 0.001 | 0.007 | 0.135 | >50 |
| Ce703010054_2A2 | C (T/F) | >50 | >50 | >50 | >50 | 0.015 | 0.260 | 0.013 | 0.075 |
| BF1266.431a | C (T/F) | >50 | >50 | 1.345 | 18.508 | 0.003 | 0.011 | >50 | >50 |
| 246F C1G | C (T/F) | 0.005 | 0.014 | >50 | >50 | >50 | >50 | >50 | >50 |
| 249M B10 | C (T/F) | 7.868 | >50 | 0.947 | 41.307 | 0.039 | 0.786 | 0.007 | 0.023 |
| ZM247v1(Rev-) | C (T/F) | 0.021 | 0.081 | 7.190 | >50 | 0.019 | 0.051 | 0.009 | >50 |
| 7030102001E5(Rev-) | C (T/F) | 0.007 | 0.022 | >50 | >50 | >50 | >50 | 0.001 | 0.011 |
| 1394C9G1(Rev-) | C (T/F) | 0.011 | 0.034 | 0.001 | 0.005 | <0.001 | 0.004 | 0.022 | 0.733 |
| Ce704809221_1B3 | C (T/F) | 0.026 | 0.072 | 0.102 | 0.710 | 0.280 | 1.099 | >50 | >50 |
| CNE19 | BC | >50 | >50 | 0.103 | 1.128 | 0.001 | 0.007 | 0.014 | >50 |
| CNE20 | BC | 0.001 | 0.004 | 0.318 | 6.970 | 0.004 | 0.014 | >50 | >50 |
| CNE21 | BC | 0.010 | 0.026 | <0.001 | 0.009 | <0.001 | 0.002 | 0.004 | 0.012 |
| CNE17 | BC | 0.432 | 1.993 | 0.091 | 1.156 | 0.007 | 0.021 | 0.093 | >50 |
| CNE30 | BC | 2.055 | 12.610 | >50 | >50 | >50 | >50 | >50 | >50 |
| CNE52 | BC | >50 | >50 | 0.020 | 0.091 | 1.147 | 9.970 | 0.004 | 0.017 |
| CNE53 | BC | 0.010 | 0.049 | 0.006 | 0.084 | 0.077 | 0.246 | >50 | >50 |
| CNE58 | BC | 13.77 | >50 | 0.183 | 7.407 | 0.004 | 0.014 | 0.004 | 0.016 |
| MS208.A1 | A | >50 | >50 | 0.334 | 17.97 | <0.001 | 0.139 | <0.001 | 0.003 |
| Q23.17 | A | 0.009 | 0.024 | 1.317 | >50 | <0.001 | 0.003 | 0.007 | 0.045 |
| Q461.e2 | A | >50 | >50 | 7.801 | >50 | 0.089 | 0.572 | 12.553 | >50 |
| Q769.d22 | A | >50 | >50 | 0.260 | 25.47 | 0.002 | 0.018 | >50 | >50 |
| Q259.d2.17 | A | >50 | >50 | 44.232 | >50 | 0.166 | >50 | >50 | >50 |
| Q842.d12 | A | 0.008 | 0.102 | 0.032 | 0.552 | <0.001 | 0.002 | 0.001 | 0.014 |
| 3415.v1.c1 | A | NT | NT | NT | NT | NT | NT | NT | NT |
| 3365.v2.c2 | A | NT | NT | NT | NT | NT | NT | NT | NT |
| 0260.v5.c36 | A | 0.058 | 0.162 | >50 | >50 | 0.033 | 0.175 | 0.427 | >50 |
| 191955_A11 | A (T/F) | 14.2 | >50 | <0.001 | <0.001 | <0.001 | 0.021 | 0.004 | 0.014 |
| 191084 B7-19 | A (T/F) | 0.022 | 0.152 | 0.028 | 0.345 | <0.001 | 0.007 | 0.004 | 0.016 |
| 9004SS_A3_4 | A (T/F) | 0.002 | 0.010 | 0.018 | 0.419 | <0.001 | 0.002 | 0.003 | 0.015 |
| T257-31 | CRF02_AG | >50 | >50 | 5.177 | >50 | 0.002 | 0.031 | 0.003 | 0.010 |
| 928-28 | CRF02_AG | >50 | >50 | >50 | >50 | 0.220 | 1.246 | >50 | >50 |
| 263-8 | CRF02_AG | 0.342 | 3.303 | 32.071 | >50 | 0.020 | 0.103 | >50 | >50 |
| T250-4 | CRF02_AG | <0.001 | 0.007 | 0.002 | 0.039 | <0.001 | <0.001 | 0.005 | 0.014 |
| T251-18 | CRF02_AG | >50 | >50 | 0.351 | 1.393 | 8.615 | 43.108 | 0.327 | >50 |
| T278-50 | CRF02_AG | 0.031 | 0.089 | 10.324 | >50 | 0.574 | 4.942 | 0.130 | >50 |
| T255-34 | CRF02_AG | >50 | >50 | >50 | >50 | 0.654 | >50 | 0.002 | 0.010 |
| 211-9 | CRF02_AG | 0.062 | 0.215 | 0.129 | 0.923 | 0.088 | 0.393 | 0.002 | 0.010 |
| 235-47 | CRF02_AG | >50 | >50 | 3.212 | 36.02 | 0.005 | 0.032 | 38.12 | >50 |
| 620345.c01 | CRF01_AE | >50 | >50 | 0.241 | 19.74 | 0.009 | 40.337 | >50 | >50 |
| CNE8 | CRF01_AE | 0.019 | 0.052 | 0.272 | 2.241 | <0.001 | 0.010 | >50 | >50 |
| C1080.c03 | CRF01_AE | 0.283 | 2.062 | 0.024 | 0.146 | <0.001 | <0.001 | >50 | >50 |
| R2184.c04 | CRF01_AE | 20.056 | >50 | 0.073 | 0.376 | 0.003 | 0.012 | >50 | >50 |
| R1166.c01 | CRF01_AE | >50 | >50 | 2.274 | 17.89 | 1.431 | 6.921 | >50 | >50 |
| R3265.c06 | CRF01_AE | >50 | >50 | 0.037 | 0.227 | 0.013 | 0.041 | >50 | >50 |
| C2101.c01 | CRF01_AE | NT | NT | NT | NT | 0.006 | 0.021 | NT | NT |
| C3347.c11 | CRF01_AE | 0.001 | 0.007 | 0.005 | 0.044 | 0.011 | 0.051 | >50 | >50 |
| C4118.c09 | CRF01_AE | >50 | >50 | <0.001 | 0.004 | 0.002 | 0.005 | >50 | >50 |
| CNE5 | CRF01_AE | 0.018 | 0.253 | 0.001 | 0.013 | <0.001 | <0.001 | >50 | >50 |
| BJOX009000.02.4 | CRF01_AE | <0.001 | 0.005 | 0.117 | 0.745 | 0.443 | 1.287 | >50 | >50 |
| BJOX015000.11.5 | CRF01_AE (T/F) | 0.001 | 0.011 | >50 | >50 | 0.520 | 10.577 | >50 | >50 |
| BJOX010000.06.2 | CRF01_AE (T/F) | 4.817 | >50 | >50 | >50 | 0.605 | 5.870 | >50 | >50 |
| BJOX025000.01.1 | CRF01_AE (T/F) | >50 | >50 | 6.632 | >50 | 0.087 | 0.573 | >50 | >50 |
| BJOX028000.10.3 | CRF01_AE (T/F) | 0.024 | 0.070 | >50 | >50 | 0.072 | 0.963 | >50 | >50 |

TABLE 22-continued

Neutralization assay data of PGT128, PGT145, PGDM1400, and PGT151 mAbs against extended multiclade virus panel. mAbs tested at primary concentration of 50 ug/ml and titrated 5-fold 7x (duplicate wells).

| | | Titer in TZM.bl cells (ug/ml) | | | | | | | |
|---|---|---|---|---|---|---|---|---|---|
| | | PGT128 | | PGT145 | | PGDM1400 | | PGT151 | |
| Virus ID | Clade* | IC50 | IC80 | IC50 | IC80 | IC50 | IC80 | IC50 | IC80 |
| X1193_c1 | G | >50 | >50 | 0.013 | 0.091 | 0.219 | 0.781 | 0.004 | 0.027 |
| P0402_c2_11 | G | 0.007 | 0.020 | 0.009 | 0.038 | 0.010 | 0.033 | <0.001 | 0.004 |
| X1254_c3 | G | >50 | >50 | 5.597 | >50 | >50 | >50 | 0.309 | >50 |
| X2088_c9 | G | >50 | >50 | >50 | >50 | >50 | >50 | >50 | >50 |
| X2131_C1_B5 | G | >50 | >50 | 0.018 | 0.065 | 0.128 | 0.568 | 0.007 | 0.036 |
| P1981_C5_3 | G | 0.019 | 0.088 | 5.413 | >50 | 0.104 | 4.601 | 0.021 | >50 |
| X1632_S2_B10 | G | >50 | >50 | 0.012 | 2.030 | 0.055 | 1.445 | 0.061 | >50 |
| 3016.v5.c45 | D | >50 | >50 | >50 | >50 | >50 | >50 | 0.174 | 40.676 |
| A07412M1.vrc12 | D | >50 | >50 | 0.002 | 0.023 | 0.032 | 0.127 | 0.246 | >50 |
| 231965.c01 | D | >50 | >50 | 0.403 | 14.96 | 0.025 | 1.280 | <0.001 | 0.012 |
| 231966.c02 | D | 3.197 | >50 | <0.001 | 0.010 | 0.001 | 0.004 | 0.025 | 0.183 |
| 3817.v2.c59 | CD | 0.003 | 0.023 | >50 | >50 | >50 | >50 | >50 | >50 |
| 6480.v4.c25 | CD | 0.003 | 0.019 | >50 | >50 | >50 | >50 | NT | NT |
| 6952.v1.c20 | CD | >50 | >50 | 3.120 | >50 | 0.501 | 11.839 | 49.232 | >50 |
| 6811.v7.c18 | CD | 0.003 | 0.050 | >50 | >50 | >50 | >50 | >50 | >50 |
| 89-F1_2_25 | CD | >50 | >50 | 0.800 | 19.97 | 0.001 | 0.005 | 22.889 | >50 |
| 3301.v1.c24 | AC | 0.067 | 0.499 | 0.219 | 4.223 | 0.048 | 0.245 | 0.002 | 0.019 |
| 6041.v3.c23 | AC | >50 | >50 | 0.964 | >50 | 0.013 | 0.289 | 0.004 | 0.024 |
| 6540.v4.c1 | AC | 11.8 | >50 | 0.080 | 5.086 | 0.004 | 0.028 | 0.006 | 0.030 |
| 6545.v4.c1 | AC | >50 | >50 | 0.114 | 3.100 | 0.003 | 0.039 | 0.004 | 0.026 |
| 0815.v3.c3 | ACD | 0.030 | 0.137 | >50 | >50 | >50 | >50 | >50 | >50 |
| 3103.v3.c10 | ACD | 0.014 | 0.033 | 0.043 | 0.164 | 0.671 | 1.998 | 0.014 | 0.202 |
| MuLV | Neg. Control | | | | | | | | |

*(T/F): Transmitted/Founder Virus

TABLE 23

Neutralization assay data of 10-1074, 10E8, PG9, and PG16 mAbs against extended multiclade virus panel. mAbs tested at primary concentration of 50 ug/ml and titrated 5-fold 7x (duplicate wells).

| | | Titer in TZM.bl cells (ug/ml) | | | | | | | |
|---|---|---|---|---|---|---|---|---|---|
| | | 10-1074 | | 10E8 | | PG9 | | PG16 | |
| Virus ID | Clade* | IC50 | IC80 | IC50 | IC80 | IC50 | IC80 | IC50 | IC80 |
| 6535.3 | B | 0.014 | 0.026 | 0.081 | 1.32 | 0.176 | 0.627 | 0.653 | >50 |
| QH0692.42 | B | 0.191 | 0.929 | 0.442 | 4.046 | >50 | >50 | >50 | >50 |
| SC422661.8 | B | 0.091 | 0.418 | 0.445 | 2.715 | 0.553 | 7.054 | 0.858 | >50 |
| PVO.4 | B | 0.074 | 0.360 | 0.747 | >10 | 10.56 | >50 | 15.27 | >50 |
| TRO.11 | B | 0.008 | 0.057 | 0.034 | 0.250 | 43.25 | >50 | 1.922 | 49.59 |
| AC10.0.29 | B | 0.022 | 0.110 | 0.132 | 1.534 | 0.117 | 0.845 | 0.023 | 0.417 |
| RHPA4259.7 | B | 0.021 | 0.118 | 0.728 | 5.275 | 22.620 | >50 | 0.375 | 3.925 |
| THRO4156.18 | B | >50 | >50 | 0.156 | 0.884 | 24.48 | >50 | 6.825 | >50 |
| REJO4541.67 | B | >50 | >50 | 0.203 | 1.686 | 0.012 | 0.163 | 0.039 | 13.36 |
| TRJO4551.58 | B | 0.17 | 0.634 | 0.475 | 4.783 | 0.503 | 4.061 | 1.008 | 24.46 |
| WITO4160.33 | B | 0.185 | 2.112 | 0.094 | 1.226 | 0.010 | 0.037 | 0.002 | 0.012 |
| CAAN5342.A2 | B | 0.007 | 0.036 | 1.284 | 9.281 | 4.603 | 26.99 | 1.831 | 33.0 |
| WEAU_d15_410_787 | B (T/F) | 0.104 | 0.375 | >10 | >10 | 4.078 | >50 | 0.435 | >50 |
| 1006_11_C3_1601 | B (T/F) | 0.003 | 0.013 | 0.172 | 2.999 | 0.366 | 1.906 | >50 | >50 |
| 1054_07_TC4_1499 | B (T/F) | 0.129 | 0.563 | 0.046 | 0.305 | >50 | >50 | >50 | >50 |
| 1056_10_TA11_1826 | B (T/F) | 0.038 | 0.272 | 0.134 | 1.028 | 6.339 | 38.26 | 0.315 | 1.952 |
| 1012_11_TC21_3257 | B (T/F) | 0.008 | 0.059 | 0.244 | 4.211 | 0.172 | 0.605 | 0.030 | 0.219 |
| 6240_08_TA5_4622 | B (T/F) | 0.068 | 0.306 | 0.756 | 5.591 | 1.747 | 6.333 | >50 | >50 |
| 6244_13_B5_4576 | B (T/F) | 0.202 | 0.922 | 0.086 | 0.809 | >50 | >50 | >50 | >50 |
| 62357_14_D3_4589 | B (T/F) | >50 | >50 | 0.119 | 1.060 | >50 | >50 | >50 | >50 |
| SC05_8C11_2344 | B (T/F) | 0.052 | 0.123 | 0.665 | 2.736 | 0.892 | 4.283 | 0.70 | 1.616 |
| Du156.12 | C | 0.015 | 0.076 | 0.034 | 0.144 | 0.026 | 0.190 | 0.006 | 0.026 |
| Du172.17 | C | 0.121 | 0.430 | 0.109 | 0.837 | 0.606 | 1.604 | 0.033 | 0.213 |
| Du422.1 | C | 0.045 | 0.166 | 0.351 | 1.883 | 0.614 | 10.4 | 0.261 | 33.84 |
| ZM197M.PB7 | C | >50 | >50 | 0.148 | 0.802 | 0.899 | 4.517 | 1.496 | 22.79 |
| ZM214M.PL15 | C | 0.174 | 2.367 | 1.962 | >10 | >50 | >50 | >50 | >50 |
| ZM233M.PB6 | C | 0.06 | 0.349 | 0.442 | 2.393 | 0.010 | 0.026 | 0.002 | 0.006 |
| ZM249M.PL1 | C | >50 | >50 | 1.511 | 6.294 | 0.166 | 1.410 | 0.127 | 18.07 |
| ZM53M.PB12 | C | >50 | >50 | 3.985 | >10 | 0.069 | 0.221 | 0.007 | 0.051 |
| ZM109F.PB4 | C | >50 | >50 | 0.295 | 1.888 | 0.256 | 6.689 | 7.033 | >50 |

TABLE 23-continued

Neutralization assay data of 10-1074, 10E8, PG9, and PG16 mAbs against extended multiclade virus panel. mAbs tested at primary concentration of 50 ug/ml and titrated 5-fold 7× (duplicate wells).

| | | Titer in TZM.bl cells (ug/ml) | | | | | | | |
|---|---|---|---|---|---|---|---|---|---|
| | | 10-1074 | | 10E8 | | PG9 | | PG16 | |
| Virus ID | Clade* | IC50 | IC80 | IC50 | IC80 | IC50 | IC80 | IC50 | IC80 |
| ZM135M.PL10a | C | 0.069 | 0.367 | 0.171 | 1.186 | 20.56 | >50 | >50 | >50 |
| CAP45.2.00.G3 | C | >50 | >50 | 1.817 | >10 | 0.007 | 0.029 | 0.001 | 0.003 |
| CAP210.2.00.E8 | C | >50 | >50 | 0.798 | 3.892 | 0.040 | 0.173 | 0.010 | 0.042 |
| HIV-001428-2.42 | C | 0.044 | 0.261 | 0.809 | 7.298 | 0.101 | 0.250 | 0.039 | 0.250 |
| HIV-0013095-2.11 | C | >50 | >50 | 0.031 | 0.213 | 0.010 | 0.030 | 0.002 | 0.006 |
| HIV-16055-2.3 | C | >50 | >50 | 0.722 | 6.495 | 0.021 | 0.06 | 0.17 | >0.250 |
| HIV-16845-2.22 | C | 1.169 | 5.835 | 0.068 | 0.495 | 4.398 | >50 | 3.126 | >50 |
| Ce1086_B2 | C (T/F) | >50 | >50 | 1.162 | 6.934 | >50 | >50 | >50 | >50 |
| Ce0393_C3 | C (T/F) | >50 | >50 | 1.179 | 7.423 | 0.020 | 0.055 | 0.002 | 0.006 |
| Ce1176_A3 | C (T/F) | 0.019 | 0.070 | 0.867 | 3.923 | 0.014 | 0.044 | 0.003 | 0.011 |
| Ce2010_F5 | C (T/F) | >50 | >50 | 1.844 | 8.612 | >50 | >50 | >50 | >50 |
| Ce0682_E4 | C (T/F) | >50 | >50 | 1.215 | 7.709 | 0.196 | 0.698 | 0.026 | 0.202 |
| Ce1172_H1 | C (T/F) | 0.047 | 0.166 | 0.722 | 4.818 | 0.070 | 0.206 | 0.007 | 0.037 |
| Ce2060_G9 | C (T/F) | >50 | >50 | 3.520 | >10 | 0.045 | 0.172 | 0.075 | 1.712 |
| Ce703010054_2A2 | C (T/F) | >50 | >50 | 2.299 | 8.579 | 0.022 | 0.103 | 0.008 | 0.053 |
| BF1266.431a | C (T/F) | >50 | >50 | 2.687 | >10 | 0.026 | 0.088 | 0.003 | 0.009 |
| 246F C1G | C (T/F) | 0.022 | 0.111 | 2.217 | 9.937 | >50 | >50 | >50 | >50 |
| 249M B10 | C (T/F) | >50 | >50 | 1.271 | 9.050 | 0.095 | 0.290 | 0.026 | 1.249 |
| ZM247v1(Rev-) | C (T/F) | 0.042 | 0.186 | 0.506 | 6.745 | 0.112 | 0.323 | 0.016 | 0.189 |
| 7030102001E5(Rev-) | C (T/F) | 0.006 | 0.021 | 6.707 | >10 | >50 | >50 | >50 | >50 |
| 1394C9G1(Rev-) | C (T/F) | 0.050 | 0.191 | 0.963 | 5.327 | 0.029 | 0.114 | 0.008 | 0.056 |
| Ce704809221_1B3 | C (T/F) | 0.139 | 0.696 | 0.058 | 0.319 | 0.037 | 0.137 | 0.021 | 0.116 |
| CNE19 | BC | 50.00 | >50 | 0.666 | 6.485 | 0.024 | 0.146 | 0.024 | 3.070 |
| CNE20 | BC | <0.001 | 0.005 | 1.246 | 6.577 | 0.052 | 0.278 | 3.633 | 47.170 |
| CNE21 | BC | 0.067 | 0.181 | 1.900 | >10 | 0.038 | 0.094 | 0.007 | 0.026 |
| CNE17 | BC | 2.686 | 13.297 | 1.114 | 5.255 | 0.210 | 0.484 | 0.029 | 0.132 |
| CNE30 | BC | 0.363 | 1.200 | 1.560 | 9.842 | >50 | >50 | >50 | >50 |
| CNE52 | BC | 1.226 | 13.147 | 0.304 | 3.056 | 0.029 | 0.081 | 0.009 | 0.026 |
| CNE53 | BC | 0.039 | 0.141 | 0.326 | 1.916 | 0.131 | 0.60 | >50 | >50 |
| CNE58 | BC | 0.267 | 0.968 | 1.289 | 8.268 | 0.038 | 0.122 | 0.044 | 0.250 |
| MS208.A1 | A | >50 | >50 | 0.609 | 3.717 | 0.005 | 0.014 | 0.002 | 0.004 |
| Q23.17 | A | 0.006 | 0.021 | 1.637 | 7.040 | 0.027 | 0.082 | 0.008 | 0.043 |
| Q461.e2 | A | >50 | >50 | 2.111 | >10 | 1.484 | 8.725 | 1.755 | >50 |
| Q769.d22 | A | >50 | >50 | 1.667 | 10.000 | 0.025 | 0.068 | 0.005 | 0.018 |
| Q259.d2.17 | A | >50 | >50 | 4.587 | >10 | 0.029 | 1.379 | 0.065 | 45.89 |
| Q842.d12 | A | >50 | >50 | 4.189 | >10 | 0.023 | 0.081 | 0.032 | >0.250 |
| 3415.v1.c1 | A | >50 | >50 | NT | NT | NT | NT | NT | NT |
| 3365.v2.c2 | A | 0.131 | 0.450 | NT | NT | NT | NT | NT | NT |
| 0260.v5.c36 | A | 0.099 | 0.160 | >10 | >10 | 1.693 | 9.0 | 1.538 | 36.08 |
| 191955_A11 | A (T/F) | >50 | >50 | 0.680 | 3.532 | 0.053 | 0.154 | 0.009 | 0.042 |
| 191084 B7-19 | A (T/F) | 0.032 | 0.128 | 5.156 | >10 | 0.043 | 0.202 | 0.024 | 0.238 |
| 9004SS_A3_4 | A (T/F) | 0.011 | 0.030 | 1.160 | 6.761 | 0.088 | 0.251 | 0.020 | 0.111 |
| T257-31 | CRF02_AG | >50 | >50 | 0.880 | 5.779 | 0.037 | 0.124 | 0.007 | 0.021 |
| 928-28 | CRF02_AG | 0.847 | 4.696 | 0.384 | 1.962 | 0.101 | 0.450 | 0.034 | 0.237 |
| 263-8 | CRF02_AG | 0.666 | 6.527 | 0.196 | 1.728 | 0.293 | 1.050 | 0.347 | 4.975 |
| T250-4 | CRF02_AG | <0.001 | 0.005 | 1.346 | 8.130 | 0.005 | 0.014 | 0.002 | 0.005 |
| T251-18 | CRF02_AG | 1.081 | 7.395 | 2.357 | >10 | >50 | >50 | 1.721 | 44.72 |
| T278-50 | CRF02_AG | 2.146 | 18.276 | 0.949 | 7.460 | 0.393 | 3.192 | 0.227 | 18.65 |
| T255-34 | CRF02_AG | >50 | >50 | 0.778 | 4.207 | 0.023 | 0.134 | 0.024 | 0.125 |
| 211-9 | CRF02_AG | 0.112 | 0.425 | 1.091 | 6.508 | 0.049 | 0.243 | 0.029 | 0.144 |
| 235-47 | CRF02_AG | 0.05 | 0.163 | 0.384 | 2.072 | 0.233 | 1.201 | 0.092 | 4.506 |
| 620345.c01 | CRF01_AE | >50 | >50 | 0.455 | 6.002 | 1.333 | >50 | >50 | >50 |
| CNE8 | CRF01_AE | >50 | >50 | NT | NT | NT | NT | NT | NT |
| C1080.c03 | CRF01_AE | >50 | >50 | 0.061 | 0.731 | 0.004 | 0.013 | 0.001 | 0.003 |
| R2184.c04 | CRF01_AE | >50 | >50 | 0.272 | 2.455 | 0.255 | 1.237 | 0.670 | >50 |
| R1166.c01 | CRF01_AE | >50 | >50 | 0.274 | 2.614 | 0.736 | 2.876 | 0.280 | 4.376 |
| R3265.c06 | CRF01_AE | NT | NT | >10 | >10 | 0.163 | 0.535 | 0.016 | 0.146 |
| C2101.c01 | CRF01_AE | >50 | >50 | 1.921 | 8.260 | 0.034 | 0.099 | 0.012 | 0.238 |
| C3347.c11 | CRF01_AE | >50 | >50 | 0.016 | 0.167 | 0.032 | 0.113 | 0.008 | 0.045 |
| C4118.c09 | CRF01_AE | >50 | >50 | 1.622 | 9.064 | 0.068 | 0.200 | 0.022 | 0.143 |
| CNE5 | CRF01_AE | >50 | >50 | 1.408 | 9.637 | 0.018 | 0.051 | 0.008 | 0.033 |
| BJOX009000.02.4 | CRF01_AE | >50 | >50 | 1.570 | 9.954 | 1.725 | 8.211 | 1.188 | 22.12 |
| BJOX015000.11.5 | CRF01_AE (T/F) | >50 | >50 | 0.051 | 1.909 | 0.322 | 1.489 | 3.129 | >50 |
| BJOX010000.06.2 | CRF01_AE (T/F) | >50 | >50 | 0.341 | 5.293 | 0.154 | 0.740 | 1.202 | >50 |
| BJOX025000.01.1 | CRF01_AE (T/F) | >50 | >50 | 0.107 | 6.325 | 0.144 | 0.335 | 0.071 | >50 |
| BJOX028000.10.3 | CRF01_AE (T/F) | >50 | >50 | 0.665 | 7.361 | 1.100 | 21.5 | >50 | >50 |

TABLE 23-continued

Neutralization assay data of 10-1074, 10E8, PG9, and PG16 mAbs against extended multiclade virus panel. mAbs tested at primary concentration of 50 ug/ml and titrated 5-fold 7× (duplicate wells).

| | | Titer in TZM.bl cells (ug/ml) | | | | | | | |
|---|---|---|---|---|---|---|---|---|---|
| | | 10-1074 | | 10E8 | | PG9 | | PG16 | |
| Virus ID | Clade* | IC50 | IC80 | IC50 | IC80 | IC50 | IC80 | IC50 | IC80 |
| X1193_c1 | G | 0.083 | 0.475 | 0.497 | 4.195 | 0.105 | 0.304 | 0.018 | 0.110 |
| P0402_c2_11 | G | 0.012 | 0.039 | 0.172 | 3.288 | 0.296 | 2.367 | 0.025 | 0.411 |
| X1254_c3 | G | 0.089 | 0.297 | 4.753 | >10 | 0.065 | 0.304 | 0.023 | 0.218 |
| X2088_c9 | G | 0.003 | 0.014 | >10 | >10 | >50 | >50 | >50 | >50 |
| X2131_C1_B5 | G | 0.016 | 0.064 | 0.189 | 0.974 | 0.084 | 0.286 | 0.024 | 0.139 |
| P1981_C5_3 | G | 0.005 | 0.017 | 0.057 | 0.285 | 0.258 | 2.512 | 0.376 | >50 |
| X1632_S2_B10 | G | >50 | >50 | 1.976 | 9.684 | 0.107 | 0.934 | 0.012 | 0.076 |
| 3016.v5.c45 | D | >50 | >50 | 0.476 | 4.393 | 2.455 | >50 | >50 | >50 |
| A07412M1.vrc12 | D | <0.001 | 0.048 | 0.576 | 6.054 | 0.697 | 7.963 | 0.343 | >50 |
| 231965.c01 | D | >50 | >50 | >10 | >10 | 1.285 | 47.97 | 1.438 | >50 |
| 231966.c02 | D | >50 | >50 | 0.191 | 3.130 | 0.075 | 0.257 | 0.007 | 0.031 |
| 3817.v2.c59 | CD | 3.148 | 14.880 | 1.181 | 5.977 | 0.020 | 0.062 | 0.008 | 0.060 |
| 6480.v4.c25 | CD | 0.009 | 0.041 | 8.079 | >10 | >50 | >50 | >50 | >50 |
| 6952.v1.c20 | CD | 0.037 | 0.138 | 0.343 | 1.907 | >50 | >50 | 21.87 | >50 |
| 6811.v7.c18 | CD | 0.002 | 0.010 | 7.535 | >10 | >50 | >50 | >50 | >50 |
| 89-F1_2_25 | CD | >50 | >50 | 1.112 | 10.000 | 0.668 | 10.1 | 47.61 | >50 |
| 3301.v1.c24 | AC | 0.013 | 0.042 | 4.628 | >10 | 0.216 | 0.756 | 0.020 | 0.087 |
| 6041.v3.c23 | AC | >50 | >50 | 2.333 | 9.766 | 0.244 | 3.639 | 0.048 | 0.256 |
| 6540.v4.c1 | AC | >50 | >50 | 1.899 | 10.000 | 0.070 | 0.253 | 0.035 | 0.420 |
| 6545.v4.c1 | AC | >50 | >50 | 1.778 | 8.229 | 0.099 | 0.351 | 0.044 | 1.561 |
| 0815.v3.c3 | ACD | 0.03 | 0.138 | 0.332 | 2.868 | >50 | >50 | >50 | >50 |
| 3103.v3.c10 | ACD | 0.037 | 0.101 | >10 | >10 | 28.004 | >50 | 25.39 | >50 |
| MuLV | Neg. Control | | | | | | | | |

*(T/F): Transmitted/Founder Virus

TABLE 24

Neutralization assay data of 3BNC117, 45-46, 8ANC195, VRC07 mAbs against extended multiclade virus panel. mAbs tested at primary concentration of 50 ug/ml and titrated 5-fold 7× (duplicate wells).

| | | Titer in TZM.bl cells (ug/ml) | | | | | | | |
|---|---|---|---|---|---|---|---|---|---|
| | | 3BNC117 | | 45-46 | | 8ANC195 | | VRC07 | |
| Virus ID | Clade* | IC50 | IC80 | IC50 | IC80 | IC50 | IC80 | IC50 | IC80 |
| 6535.3 | B | 0.55 | 2.44 | 0.14 | 0.28 | 0.20 | 0.91 | 0.169 | 0.517 |
| QH0692.42 | B | 0.13 | 0.49 | 0.55 | 1.56 | 2.71 | 17.08 | 0.500 | 1.861 |
| SC422661.8 | B | 0.02 | 0.08 | 0.01 | 0.07 | 0.29 | 4.67 | 0.054 | 0.175 |
| PVO.4 | B | <0.09 | 0.19 | 0.17 | 0.47 | 0.52 | 1.87 | 0.063 | 0.226 |
| TRO.11 | B | <0.09 | <0.09 | 1.90 | 9.56 | 0.18 | 0.89 | 0.132 | 0.456 |
| AC10.0.29 | B | 13.84 | >50 | 0.42 | 1.49 | 0.88 | 7.00 | 0.282 | 0.986 |
| RHPA4259.7 | B | <0.09 | <0.09 | <0.05 | <0.05 | 0.34 | 1.56 | 0.017 | 0.048 |
| THRO4156.18 | B | 1.76 | 10.14 | 1.59 | 6.02 | >50 | >50 | 2.404 | 12.200 |
| REJO4541.67 | B | 0.01 | 0.05 | 0.003 | 0.010 | 0.08 | 0.68 | 0.011 | 0.037 |
| TRJO4551.58 | B | 0.05 | 0.19 | 0.01 | 0.05 | 0.19 | 1.17 | 0.032 | 0.125 |
| WITO4160.33 | B | 0.01 | 0.04 | 0.01 | 0.08 | >50 | >50 | 0.042 | 0.193 |
| CAAN5342.A2 | B | 0.42 | 1.51 | 0.11 | 0.33 | >50 | >50 | 0.307 | 1.053 |
| WEAU_d15_410_787 | B (T/F) | 0.05 | 0.19 | 0.01 | 0.03 | >50 | >50 | 0.034 | 0.115 |
| 1006_11_C3_1601 | B (T/F) | 0.03 | 0.10 | 0.05 | 0.31 | 0.43 | 1.98 | 0.015 | 0.046 |
| 1054_07_TC4_1499 | B (T/F) | 0.07 | 0.49 | 0.07 | 0.61 | 1.02 | 6.75 | 0.239 | 1.459 |
| 1056_10_TA11_1826 | B (T/F) | 0.30 | 1.82 | 0.12 | 0.59 | >50 | >50 | 0.239 | 1.110 |
| 1012_11_TC21_3257 | B (T/F) | 0.02 | 0.07 | 0.01 | 0.04 | >50 | >50 | 0.014 | 0.045 |
| 6240_08_TA5_4622 | B (T/F) | 0.33 | 1.17 | 0.44 | 1.55 | >50 | >50 | 0.448 | 1.540 |
| 6244_13_B5_4576 | B (T/F) | 0.04 | 0.15 | 0.07 | 0.26 | >50 | >50 | 0.065 | 0.230 |
| 62357_14_D3_4589 | B (T/F) | 0.06 | 0.26 | 0.05 | 0.22 | >50 | >50 | 0.075 | 0.256 |
| SC05_8C11_2344 | B (T/F) | 0.15 | 0.51 | 0.14 | 0.38 | 0.47 | 3.06 | 0.133 | 0.401 |
| Du156.12 | C | 0.02 | 0.08 | 0.01 | 0.05 | 0.22 | 1.56 | 0.041 | 0.149 |
| Du172.17 | C | 1.19 | 8.90 | >30 | >30 | >30 | >30 | 0.796 | 3.661 |
| Du422.1 | C | >50 | >50 | >50 | >50 | >50 | >50 | >50 | >50 |
| ZM197M.PB7 | C | 0.22 | 1.03 | 0.14 | 0.64 | 23.45 | >50 | 0.307 | 1.275 |
| ZM214M.PL15 | C | 0.06 | 0.52 | 0.05 | 0.39 | 0.91 | 12.30 | 0.198 | 1.417 |
| ZM233M.PB6 | C | 0.13 | 0.85 | 1.86 | 16.52 | 7.39 | 43.45 | 0.152 | 0.625 |
| ZM249M.PL1 | C | 0.03 | 0.11 | 0.02 | 0.06 | >50 | >50 | 0.041 | 0.145 |
| ZM53M.PB12 | C | 0.21 | 0.85 | 0.65 | 0.65 | >30 | >30 | 0.275 | 1.294 |
| ZM109F.PB4 | C | 0.14 | 0.88 | 0.22 | 0.22 | >30 | >30 | 0.112 | 0.389 |

TABLE 24-continued

Neutralization assay data of 3BNC117, 45-46, 8ANC195, VRC07 mAbs against extended multiclade virus panel. mAbs tested at primary concentration of 50 ug/ml and titrated 5-fold 7x (duplicate wells).

| | | Titer in TZM.bl cells (ug/ml) | | | | | | | |
|---|---|---|---|---|---|---|---|---|---|
| | | 3BNC117 | | 45-46 | | 8ANC195 | | VRC07 | |
| Virus ID | Clade* | IC50 | IC80 | IC50 | IC80 | IC50 | IC80 | IC50 | IC80 |
| ZM135M.PL10a | C | 0.03 | 0.13 | 0.36 | 3.11 | >50 | >50 | 0.104 | 0.383 |
| CAP45.2.00.G3 | C | 3.88 | >50 | >50 | >50 | 28.30 | >50 | 0.355 | 3.087 |
| CAP210.2.00.E8 | C | 17.22 | >50 | >50 | >50 | >50 | >50 | >50 | >50 |
| HIV-001428-2.42 | C | 0.003 | 0.02 | <0.001 | 0.01 | >50 | >50 | 0.004 | 0.016 |
| HIV-0013095-2.11 | C | 0.33 | 2.53 | 0.01 | 0.03 | 0.32 | 1.85 | 0.017 | 0.057 |
| HIV-16055-2.3 | C | 5.60 | >50 | 0.02 | 0.06 | 15.30 | >50 | 0.025 | 0.135 |
| HIV-16845-2.22 | C | 27.46 | >50 | 2.05 | 12.10 | 3.30 | 20.06 | 1.207 | 6.154 |
| Ce1086_B2 | C (T/F) | 0.09 | 0.31 | 0.04 | 0.28 | 4.42 | 19.11 | 0.128 | 0.840 |
| Ce0393_C3 | C (T/F) | 0.20 | 0.67 | 0.32 | 1.07 | 6.77 | >50 | 0.182 | 0.634 |
| Ce1176_A3 | C (T/F) | 0.22 | 0.75 | 1.29 | 5.55 | 4.45 | 35.17 | 0.520 | 2.600 |
| Ce2010_F5 | C (T/F) | 0.05 | 0.21 | 0.13 | 0.43 | >50 | >50 | 0.131 | 0.480 |
| Ce0682_E4 | C (T/F) | 0.03 | 0.15 | 0.07 | 0.25 | 0.20 | 1.29 | 0.039 | 0.239 |
| Ce1172_H1 | C (T/F) | >50 | >50 | >50 | >50 | 42.30 | >50 | >50 | >50 |
| Ce2060_G9 | C (T/F) | 0.24 | 0.81 | 0.14 | 0.48 | 6.20 | >50 | 0.085 | 0.422 |
| Ce703010054_2A2 | C (T/F) | 0.37 | 1.67 | 0.22 | 0.97 | 13.62 | >50 | 0.190 | 0.912 |
| BF1266.431a | C (T/F) | 0.03 | 0.09 | 0.01 | 0.03 | >50 | >50 | 0.032 | 0.117 |
| 246F C1G | C (T/F) | 19.32 | >50 | >50 | >50 | 12.81 | >50 | 0.286 | 1.041 |
| 249M B10 | C (T/F) | 0.10 | 0.40 | 0.04 | 0.17 | >50 | >50 | 0.052 | 0.204 |
| ZM247v1(Rev-) | C (T/F) | >50 | >50 | 1.64 | >50 | 3.41 | 25.12 | 0.041 | 0.189 |
| 7030102001E5(Rev-) | C (T/F) | 0.29 | 1.44 | 0.14 | 0.63 | 0.86 | 8.32 | 0.205 | 0.911 |
| 1394C9G1(Rev-) | C (T/F) | >50 | >50 | 0.09 | 0.38 | >50 | >50 | 0.112 | 0.368 |
| Ce704809221_1B3 | C (T/F) | 0.08 | 0.31 | 0.15 | 0.88 | 0.48 | 3.52 | 0.273 | 1.137 |
| CNE19 | BC | 0.02 | 0.08 | 0.07 | 0.37 | 0.29 | 1.73 | 0.092 | 0.232 |
| CNE20 | BC | >50 | >50 | 8.71 | 47.01 | 0.50 | 3.19 | 0.060 | 0.129 |
| CNE21 | BC | 45.38 | >50 | 7.53 | >50 | 0.27 | 1.52 | 0.050 | 0.222 |
| CNE17 | BC | 5.76 | 42.98 | 0.15 | 0.55 | 2.59 | 11.07 | 0.136 | 0.651 |
| CNE30 | BC | 0.26 | 0.85 | 0.34 | 1.48 | 7.52 | 40.45 | 0.326 | 1.084 |
| CNE52 | BC | 0.02 | 0.06 | 0.03 | 0.12 | 5.59 | 43.09 | 0.042 | 0.142 |
| CNE53 | BC | 0.08 | 0.99 | 0.01 | 0.04 | >50 | >50 | 0.031 | 0.086 |
| CNE58 | BC | 0.25 | 2.03 | 0.25 | 1.49 | >50 | >50 | 0.110 | 0.298 |
| MS208.A1 | A | 0.01 | 0.09 | 0.09 | 0.60 | >50 | >50 | 0.120 | 0.425 |
| Q23.17 | A | 0.005 | 0.020 | 0.14 | 0.60 | 2.55 | 2.55 | 0.081 | 0.236 |
| Q461.e2 | A | 0.03 | 0.09 | 0.06 | 0.32 | 0.63 | 2.51 | 0.282 | 1.025 |
| Q769.d22 | A | 0.01 | 0.04 | 0.01 | 0.04 | 0.26 | 1.20 | 0.018 | 0.087 |
| Q259.d2.17 | A | 0.01 | 0.05 | 0.01 | 0.06 | >50 | >50 | 0.024 | 0.100 |
| Q842.d12 | A | <0.01 | 0.01 | 0.03 | 0.03 | >30 | >30 | 0.015 | 0.051 |
| 3415.v1.c1 | A | 0.17 | 0.47 | 0.07 | 0.07 | 17.74 | 17.74 | 0.036 | 0.152 |
| 3365.v2.c2 | A | 0.03 | 0.10 | 0.11 | 0.11 | >30 | >30 | 0.038 | 0.109 |
| 0260.v5.c36 | A | NT | NT | NT | NT | NT | NT | 0.448 | 1.619 |
| 191955_A11 | A (T/F) | >50 | >50 | 0.11 | 0.43 | >50 | >50 | 0.978 | 4.824 |
| 191084 B7-19 | A (T/F) | 0.07 | 0.23 | 0.02 | 0.07 | >50 | >50 | 0.061 | 0.209 |
| 9004SS_A3_4 | A (T/F) | 0.07 | 0.18 | 0.18 | 0.65 | 0.17 | 0.81 | 0.218 | 0.750 |
| T257-31 | CRF02_AG | 0.06 | 0.37 | 0.23 | 1.11 | 0.32 | 3.89 | 0.421 | 3.172 |
| 928-28 | CRF02_AG | 0.15 | 0.55 | 0.10 | 0.39 | >50 | >50 | 0.278 | 0.957 |
| 263-8 | CRF02_AG | 0.005 | 0.040 | 0.05 | 0.10 | >50 | >50 | 0.103 | 0.282 |
| T250-4 | CRF02_AG | >15 | >15 | >30 | >30 | >50 | >50 | >50 | >50 |
| T251-18 | CRF02_AG | 0.26 | 0.82 | 5.26 | 5.26 | 1.51 | 1.51 | 1.322 | 6.491 |
| T278-50 | CRF02_AG | >15 | >15 | >30 | >30 | >50 | >50 | >50 | >50 |
| T255-34 | CRF02_AG | 0.02 | 0.14 | 0.23 | 2.38 | 0.54 | 8.09 | 0.227 | 0.987 |
| 211-9 | CRF02_AG | 0.35 | 1.28 | >50 | >50 | 1.34 | 8.43 | 5.919 | 37.988 |
| 235-47 | CRF02_AG | 0.03 | 0.12 | 0.30 | 1.49 | >50 | >50 | 0.024 | 0.075 |
| 620345.c01 | CRF01_AE | >15 | >15 | >30 | >30 | >50 | >50 | >50 | >50 |
| CNE8 | CRF01_AE | NT | NT | NT | NT | NT | NT | 0.450 | 1.563 |
| C1080.c03 | CRF01_AE | 0.25 | 1.73 | 1.79 | 18.04 | 0.17 | 1.12 | 2.032 | 8.251 |
| R2184.c04 | CRF01_AE | 0.03 | 0.10 | 0.03 | 0.12 | 0.09 | 12.98 | 0.020 | 0.104 |
| R1166.c01 | CRF01_AE | 0.17 | 0.64 | 1.68 | 1.68 | 4.83 | 4.83 | 0.810 | 3.167 |
| R3265.c06 | CRF01_AE | 0.48 | 13.04 | 0.04 | 0.44 | 50.00 | >50 | NT | NT |
| C2101.c01 | CRF01_AE | 0.05 | 0.31 | 12.78 | >50 | 0.48 | 3.54 | 0.238 | 1.404 |
| C3347.c11 | CRF01_AE | 0.03 | 0.13 | 0.03 | 0.18 | >50 | >50 | 0.060 | 0.380 |
| C4118.c09 | CRF01_AE | 0.09 | 0.52 | 0.14 | 0.91 | 0.20 | 0.71 | 0.121 | 0.444 |
| CNE5 | CRF01_AE | 0.28 | 1.28 | 0.09 | 0.41 | 2.12 | 9.67 | 0.138 | 0.524 |
| BJOX009000.02.4 | CRF01_AE | 0.40 | 1.79 | 0.26 | 1.16 | 0.64 | 3.09 | 0.806 | 2.899 |
| BJOX015000.11.5 | CRF01_AE (T/F) | 0.05 | 0.32 | 0.06 | 0.38 | 0.97 | 4.30 | 0.054 | 0.479 |
| BJOX010000.06.2 | CRF01_AE (T/F) | 1.58 | 10.45 | 0.87 | 6.37 | 0.85 | 5.84 | 1.061 | 10.035 |
| BJOX025000.01.1 | CRF01_AE (T/F) | 0.05 | 0.20 | 0.18 | 10.00 | 4.96 | >50 | 0.279 | 2.295 |
| BJOX028000.10.3 | CRF01_AE (T/F) | 0.01 | 0.05 | 0.07 | >50 | 0.45 | 2.83 | 0.011 | 0.069 |

TABLE 24-continued

Neutralization assay data of 3BNC117, 45-46, 8ANC195, VRC07 mAbs against extended multiclade virus panel. mAbs tested at primary concentration of 50 ug/ml and titrated 5-fold 7x (duplicate wells).

| | | Titer in TZM.bl cells (ug/ml) | | | | | | | |
|---|---|---|---|---|---|---|---|---|---|
| | | 3BNC117 | | 45-46 | | 8ANC195 | | VRC07 | |
| Virus ID | Clade* | IC50 | IC80 | IC50 | IC80 | IC50 | IC80 | IC50 | IC80 |
| X1193_c1 | G | 0.06 | 0.25 | 0.04 | 0.16 | 0.27 | 1.66 | 0.037 | 0.249 |
| P0402_c2_11 | G | 0.06 | 0.38 | 0.06 | 0.26 | 0.62 | 6.35 | 0.085 | 0.422 |
| X1254_c3 | G | 0.08 | 0.27 | 0.08 | 0.08 | 6.95 | 6.95 | 0.041 | 0.200 |
| X2088_c9 | G | >50 | >50 | >50 | >50 | >50 | >50 | >50 | >50 |
| X2131_C1_B5 | G | 0.43 | 1.96 | 0.20 | 0.90 | 3.47 | >50 | 0.219 | 1.033 |
| P1981_C5_3 | G | 0.74 | 3.62 | 0.05 | 0.22 | 0.14 | 1.15 | 0.213 | 0.609 |
| X1632_S2_B10 | G | 15.69 | >50 | 0.07 | >50 | 0.47 | 4.11 | 0.023 | 0.107 |
| 3016.v5.c45 | D | 1.38 | >30 | >30 | >30 | 0.87 | >50 | 0.095 | 0.392 |
| A07412M1.vrc12 | D | 0.02 | 0.10 | 0.03 | 0.13 | 2.25 | 7.49 | 0.110 | 0.353 |
| 231965.c01 | D | 0.05 | 0.22 | 0.10 | 0.10 | 2.36 | 2.36 | 0.085 | 0.263 |
| 231966.c02 | D | 0.29 | 2.37 | 1.11 | 11.36 | 0.54 | 2.98 | 0.105 | 0.471 |
| 3817.v2.c59 | CD | 0.15 | 0.52 | >50 | >50 | 1.00 | 5.30 | 1.900 | 19.842 |
| 6480.v4.c25 | CD | 0.01 | 0.04 | 0.02 | 0.08 | 0.16 | 1.13 | 0.032 | 0.134 |
| 6952.v1.c20 | CD | 0.15 | 0.75 | 0.02 | 0.07 | 1.38 | 7.22 | 0.064 | 0.181 |
| 6811.v7.c18 | CD | 0.03 | 0.17 | 0.03 | 0.13 | 5.34 | 27.63 | 0.093 | 0.435 |
| 89-F1_2_25 | CD | >50 | >50 | >50 | >50 | >50 | >50 | >50 | >50 |
| 3301.v1.c24 | AC | 0.01 | 0.05 | 0.01 | 0.03 | >50 | >50 | 0.027 | 0.073 |
| 6041.v3.c23 | AC | 0.01 | 0.07 | 0.01 | 0.04 | >50 | >50 | 0.018 | 0.058 |
| 6540.v4.c1 | AC | >50 | >50 | >50 | >50 | >50 | >50 | >50 | >50 |
| 6545.v4.c1 | AC | >50 | >50 | >50 | >50 | 26.94 | >50 | >50 | >50 |
| 0815.v3.c3 | ACD | 0.01 | 0.02 | 0.01 | 0.03 | 1.94 | 1.94 | 0.015 | 0.051 |
| 3103.v3.c10 | ACD | 0.22 | 0.85 | 1.66 | 6.57 | 48.07 | >50 | 0.675 | 1.951 |
| MuLV | Neg. Control | | | | | | | | |

*(T/F): Transmitted/Founder Virus

TABLE 25

Neutralization assay data of VRC01 mAb against extended multiclade virus panel. mAbs tested at primary concentration of 50 ug/ml and titrated 5-fold 7x (duplicate wells).

| | | Titer in TZM.bl cells (ug/ml) | |
|---|---|---|---|
| | | VRC01 | |
| Virus ID | Clade* | IC50 | IC80 |
| 6535.3 | B | 0.54 | 2.7 |
| QH0692.42 | B | 1.50 | 4.8 |
| SC422661.8 | B | 0.08 | 0.265 |
| PVO.4 | B | 0.22 | 1.2 |
| TRO.11 | B | 0.21 | 0.83 |
| AC10.0.29 | B | 2.20 | 6.5 |
| RHPA4259.7 | B | 0.06 | 0.185 |
| THRO4156.18 | B | 2.30 | 23 |
| REJO4541.67 | B | 0.06 | 0.25 |
| TRJO4551.58 | B | 0.08 | 0.21 |
| WITO4160.33 | B | 0.15 | 0.41 |
| CAAN5342.A2 | B | 0.82 | 2.8 |
| WEAU_d15_410_787 | B (T/F) | 0.12 | 0.26 |
| 1006_11_C3_1601 | B (T/F) | 0.15 | 0.39 |
| 1054_07_TC4_1499 | B (T/F) | 0.71 | 2.85 |
| 1056_10_TA11_1826 | B (T/F) | 0.92 | 3.28 |
| 1012_11_TC21_3257 | B (T/F) | 0.12 | 0.32 |
| 6240_08_TA5_4622 | B (T/F) | 0.61 | 1.82 |
| 6244_13_B5_4576 | B (T/F) | 0.21 | 0.53 |
| 62357_14_D3_4589 | B (T/F) | 0.96 | 4.68 |
| SC05_8C11_2344 | B (T/F) | 0.64 | 1.91 |
| Du156.12 | C | 0.09 | 0.193 |
| Du172.17 | C | >50 | >50 |
| Du422.1 | C | >50 | >50 |
| ZM197M.PB7 | C | 0.36 | 1.6 |
| ZM214M.PL15 | C | 0.44 | 2.6 |
| ZM233M.PB6 | C | 2.00 | 9.3 |
| ZM249M.PL1 | C | 0.05 | 0.23 |
| ZM53M.PB12 | C | 1.30 | 4 |
| ZM109F.PB4 | C | 0.13 | 0.75 |
| ZM135M.PL10a | C | 0.35 | 2.7 |
| CAP45.2.00.G3 | C | 2.30 | >50 |
| CAP210.2.00.E8 | C | >50 | >50 |
| HIV-001428-2.42 | C | 0.02 | 0.06 |
| HIV-0013095-2.11 | C | 0.11 | 0.33 |
| HIV-16055-2.3 | C | 0.08 | 0.26 |
| HIV-16845-2.22 | C | 2.80 | 12.69 |
| Ce1086_B2 | C (T/F) | 0.42 | 1.44 |
| Ce0393_C3 | C (T/F) | 0.62 | 2.37 |
| Ce1176_A3 | C (T/F) | 2.25 | 8.10 |
| Ce2010_F5 | C (T/F) | 0.32 | 1.07 |
| Ce0682_E4 | C (T/F) | 0.08 | 0.48 |
| Ce1172_H1 | C (T/F) | >10 | >10 |
| Ce2060_G9 | C (T/F) | 0.29 | 1.48 |
| Ce703010054_2A2 | C (T/F) | 0.53 | 1.84 |
| BF1266.431a | C (T/F) | 0.07 | 0.23 |
| 246F C1G | C (T/F) | >10 | >10 |
| 249M B10 | C (T/F) | 0.13 | 0.46 |
| ZM247v1(Rev-) | C (T/F) | 0.35 | 1.29 |
| 7030102001E5(Rev-) | C (T/F) | 0.54 | 2.08 |
| 1394C9G1 (Rev-) | C (T/F) | 0.36 | 1.28 |
| Ce704809221_1B3 | C (T/F) | 0.55 | 2.05 |
| CNE19 | BC | NT | NT |
| CNE20 | BC | NT | NT |
| CNE21 | BC | NT | NT |
| CNE17 | BC | NT | NT |
| CNE30 | BC | NT | NT |
| CNE52 | BC | NT | NT |
| CNE53 | BC | NT | NT |
| CNE58 | BC | NT | NT |

TABLE 25-continued

Neutralization assay data of VRC01 mAb against extended multiclade virus panel. mAbs tested at primary concentration of 50 ug/ml and titrated 5-fold 7x (duplicate wells).

| | | Titer in TZM.bl cells (ug/ml) VRC01 | |
|---|---|---|---|
| Virus ID | Clade* | IC50 | IC80 |
| MS208.A1 | A | 0.10 | 0.46 |
| Q23.17 | A | 0.09 | 0.261 |
| Q461.e2 | A | 0.49 | 1.6 |
| Q769.d22 | A | 0.08 | 0.29 |
| Q259.d2.17 | A | 0.17 | 0.54 |
| Q842.d12 | A | 0.03 | 0.096 |
| 3415.v1.c1 | A | 0.06 | 0.15 |
| 3365.v2.c2 | A | 0.06 | 0.17 |
| 0260.v5.c36 | A | NT | NT |
| 191955_A11 | A (T/F) | NT | NT |
| 191084 B7-19 | A (T/F) | NT | NT |
| 9004SS_A3_4 | A (T/F) | NT | NT |
| T257-31 | CRF02_AG | 2.80 | 8.66 |
| 928-28 | CRF02_AG | 0.41 | 1.7 |
| 263-8 | CRF02_AG | 0.20 | 0.55 |
| T250-4 | CRF02_AG | >50 | >50 |
| T251-18 | CRF02_AG | 2.50 | 11.17 |
| T278-50 | CRF02_AG | >50 | >50 |
| T255-34 | CRF02_AG | 0.70 | 2.7 |
| 211-9 | CRF02_AG | 14.30 | >50 |
| 235-47 | CRF02_AG | 0.04 | 0.17 |
| 620345.c01 | CRF01_AE | >50 | >50 |
| CNE8 | CRF01_AE | NT | NT |
| C1080.c03 | CRF01_AE | 3.40 | 14.37 |
| R2184.c04 | CRF01_AE | 0.08 | 0.32 |
| R1166.c01 | CRF01_AE | 1.70 | 4.58 |
| R3265.c06 | CRF01_AE | 0.45 | 1.88 |
| C2101.c01 | CRF01_AE | 0.36 | 1.17 |
| C3347.c11 | CRF01_AE | 0.17 | 0.58 |
| C4118.c09 | CRF01_AE | NT | NT |
| CNE5 | CRF01_AE | 0.37 | 1.1 |
| BJOX009000.02.4 | CRF01_AE | NT | NT |
| BJOX015000.11.5 | CRF01_AE (T/F) | NT | NT |
| BJOX010000.06.2 | CRF01_AE (T/F) | NT | NT |
| BJOX025000.01.1 | CRF01_AE (T/F) | NT | NT |
| BJOX028000.10.3 | CRF01_AE (T/F) | NT | NT |
| X1193_c1 | G | 0.11 | 0.32 |
| P0402_c2_11 | G | 0.21 | 0.59 |
| X1254_c3 | G | 0.07 | 0.19 |
| X2088_c9 | G | >50 | >50 |
| X2131_C1_B5 | G | 0.51 | 1.54 |
| P1981_C5_3 | G | 0.46 | 1.26 |
| X1632_S2_B10 | G | 0.12 | 0.74 |
| 3016.v5.c45 | D | 0.16 | 0.42 |
| A07412M1.vrc12 | D | NT | NT |
| 231965.c01 | D | 0.34 | 1.2 |
| 231966.c02 | D | NT | NT |
| 3817.v2.c59 | CD | >50 | >50 |
| 6480.v4.c25 | CD | 0.04 | 0.09 |
| 6952.v1.c20 | CD | 0.04 | 0.12 |
| 6811.v7.c18 | CD | 0.09 | 0.26 |
| 89-F1_2_25 | CD | NT | NT |
| 3301.v1.c24 | AC | 0.14 | 0.32 |
| 6041.v3.c23 | AC | 0.02 | 0.08 |
| 6540.v4.c1 | AC | >50 | >50 |
| 6545.v4.c1 | AC | >50 | >50 |
| 0815.v3.c3 | ACD | 0.06 | 0.13 |
| 3103.v3.c10 | ACD | 0.93 | 2.49 |
| MuLV | Neg. Control | | |

*(T/F): Transmitted/Founder Virus

Throughout this disclosure, various publications, patents and published patent specifications are referenced by an identifying citation. The disclosures of these publications, patents and published patent specifications are hereby incorporated by reference into the present disclosure to more fully describe the state of the art to which this invention pertains.

While the present teachings are described in conjunction with various embodiments, it is not intended that the present teachings be limited to such embodiments. On the contrary, the present teachings encompass various alternatives, modifications, and equivalents, as will be appreciated by those of skill in the art.

SEQUENCE LISTING (500 sequences)

SEQ ID NO: 1 - protein, 458 aa, Homo sapiens
AGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2 - protein, 205 aa, Homo sapiens
QSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3 - protein, 457 aa, Homo sapiens
ADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4 - protein, 205 aa, Homo sapiens
QSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5 - protein, 444 aa, Homo sapiens
ADLVQSGAVVKKPGDSVRISCEAQGYKFPDYIIHWIRRAPGQGLEWMGWINPMGGQVNIPWQFQGRVSMTRDTSIETAFLDLRGLKSDDTALYYCVRDRSNGSGRRFESSNWFLDLWGRGTAVTVHSPSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6 - protein, 205 aa, Homo sapiens
QSALTQPRSVSASPGQSVTISCTGTHNLVSWCQHHPGRAPKLLIYDFNKRPSGVPDRFSGSGSGGTASLTISGLQDDDDAEYFCWAYEAFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7 - protein, 458 aa, Homo sapiens
SAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8 - protein, 205 aa, Homo sapiens
QCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 9 - protein, 457 aa, Homo sapiens
ADLVQSGAVMKKPGDSVRISCEARGYTFTDYVIHWIRRAPGQGLEWMGWIDPPYGQVNIPWNFQGRVSMTRDTSIETAFLDLRGLKSDDTGLYYCVRDRSNGWGKRFESSNWFLDLWGRGTVVTVHSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10 - protein, 205 aa, Homo sapiens; identical to SEQ ID NO: 6

SEQ ID NO: 11 - protein, 457 aa, Homo sapiens
ADLVQSGAVVKKPGDSVRISCEAQGYTFTDYVIHWIRRAPGQGLEWMGWINPGYGQVNIPWNFQGRVSMTRDTSIETAFLDLRGLKSDDTGLYYCVRDRSNGWGKRFESSNWFLDLWGRGTVVTVHSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12 - protein, 205 aa, Homo sapiens
QSALTQPRSMSASPGQSVTISCTGTHNLVSWCQHHPGRPPKLLIYDFNKRPSGVPDRFSGSGSGGTASLTISGLQDDDDAEYICWAYEAFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 13 - protein, 457 aa, Homo sapiens
ADLVQSGAVVKNAGASVRVSCEAYGYTFVDYFIHWVRQAPGQGFEWMGYMDPLNGRPNIARKFQGRLSLSRDRSSETSFLDLSGLRSDDSAVYYCVRDKSNGSGRRFDSSNWFLDLWGRGTRVSIFSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 14 - protein, 205 aa, Homo sapiens
QSALTQPRSVSATPGQSVTISCTGTHNYVSWCQQHPGRAPKLLIYDFNKRPSGVPDRFSGSGSGGTASLTITGLQDDDEADYFCWAYDAFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 15 - protein, 457 aa, Homo sapiens
ADLVQSGAVVKKPGDSVRVSCEAYGYTFSDYIIHWIRRAPGRGLEWMGWMNPMGGQVNIPWNFQGRVSMTRDTSIETAFLDLRGLRSDDTAVYYCVRDRSNGSGKRFESSNWFLDLWGRGTAVTISSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16 - protein, 205 aa, Homo sapiens
QSALTQPRSVSAAPGQSVTISCTGTHNLVSWCQHHPGRAPKLLIYDFNKRPSGVPDRFSGSGSGGTASLTITGLQDDDEAEYFCWAYEVFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 17 - protein, 457 aa, Homo sapiens
ADLVQSGAVVKTPGASVRVSCEAYGYTFIDYIIHWVRQAPGQGFEWLGYIDPMNGRPNIARKFQGRLSLSRDTSIETSFLDLSGLRSDDSAVYYCVRDKSNGSGKRFDSSNWFLDLWGRGTRVSISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18 - protein, 205 aa, Homo sapiens
QSALTQPRSVSAAPGQSVTISCTGTHNYVSWCQQHPGRAPKLLIYDFNKRPSGVPDRFSGSGSGGTASLTITRLQDDDDADYFCWAYDAFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 19 - protein, 457 aa, Homo sapiens
ADLVQSGAVVKKPGASVRVSCEAYGYTFTDYIIHWIRQAPGQGLEWMGWMNPMGGRTNIPWKFQGRVSMTRDTSIETAFLDLSGLTSDDTAVYYCVRDKSNGSGKRFDSSNWFLDLWGRGTPVTISSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20 - protein, 205 aa, Homo sapiens
QSALTQPRSVSAAPGQSVTISCTGTHNLVSWCQQHPGRAPKLLIYDFNKRPSGVPDRFSGSGSGGTASLSITGLQDDDEAEYFCWAYEAFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 21 - protein, 457 aa, Homo sapiens
ADLVQSGAVVKKPGASVRVSCEAYGYTFVDYLIHWVRQAPGQGFEWMGYMDPMNGRPNIARKFQGRLSLSRDTSIETSFLDLSGLRSDDSAVYYCVRDKSGGSGKLFDSSNWFLDLWGRGTRVSISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22 - protein, 205 aa, Homo sapiens
QSALTQPRSVSAAPGQSVTISCTGTHNYVSWCQQHPGRAPKLLIYDFNKRPSGVPDRFSGSGSGGTASLTITGLQDDDDADYFCWAYDAFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 23 - protein, 457 aa, Homo sapiens
ADLVQSGAVVKKPGDSVRISCEAQGYTFTDYVIHWIRRAPGQGLEWMGWINPGYGQVNIPWNFQGRVSMTRDTSIETAFLELRGLKSDDTGLYYCVRDRSNGWGKRFESSNWFLDLWGRGTVITVHSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 24 - protein, 205 aa, Homo sapiens
QSALTQPRSMSASPGQSVTISCTGTHNLVSWCQHHPGRPPKLLIYDFNKRPSGVPDRFSGSGSGGTASLTITGLQDDDDAEYICWAYEAFGGGTKLTILRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 25 - protein, 457 aa, Homo sapiens
ADLVQSGAVVKKPGDSVRISCEAQGYTFTDYVIHWIRRAPGQGLEWMGWMDPSYGQVNIPRNFQGRVSMTRDTFRETAYLELRGLQSDDKGLYYCVRDRSHGSGRQFESSNWFLDLWGRGTVVNVQSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26 - protein, 205 aa, Homo sapiens
QSALTQPRSVSASPGQSVTISCTGTHNLVSWCQHHPGRPPKLLIYDFNKRASGVPDRFSGSGSGGTASLTISGLQDDDDAEYFCWAYEAFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 27 - protein, 457 aa, Homo sapiens
ADLVQSGAVVKKPGDSLRISCEAQGYTFTDYVIHWIRRAPGQGLEWMGWMDPSFGQMNIPRNFQGRVSMTRDMYIETAFLDLRGLKSDDTGLYYCVRDRSHGSGRLFESSNWFLDLWGRGTVVTVQSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28 - protein, 205 aa, Homo sapiens; identical to SEQ ID NO: 26

SEQ ID NO: 29 - protein, 457 aa, Homo sapiens
ADLVQSGAVVKKPGDSVRISCEAQGYRFTDYVIHWIRRAPGQGLEWMGLMDPSFGRMNIPRKFQGRVSMTRDTSMETAFLDFRGLNFDDTGLYYCVRDRSHGSGRLFESSNWFLDLWGRGTVVTVQSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30 - protein, 205 aa, Homo sapiens; identical to SEQ ID NO: 26

SEQ ID NO: 31 - protein, 457 aa, Homo sapiens
ADLVQSGAVVKKPGDSVRISCEAQGYTFIDYVIHWIRRAPGQGLEWMGLMDPTYGRMNIPRKFQGRVSMTRDTSIETAFLDLRGLKSDDTGLYYCVRDRSHGSGRLFESSNWFLDLWGRGTVVTVQSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32 - protein, 205 aa, Homo sapiens; identical to SEQ ID NO: 26

SEQ ID NO: 33 - protein, 457 aa, Homo sapiens
ADLVQSGAVVKKPGDSVRISCEAQGYRFLDYIIHWIRRAPGQGLEWMGWMNPMGGQVNIPWNFQGRVSMTRDTSIETAFLDLRGLKSDDTAVYYCVRDRSNGSGKRFESSNWFLDLWGRGTAVTIHSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 34 - protein, 205 aa, Homo sapiens
QSALTQPRSVSASPGQSVTISCTGTHNLVSWCQHHPGRAPKLLIYDFNKRPSGVPDRFSGSGSGGTASLTITGLQDDDDAEYFCWAYEAFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 35 - protein, 450 aa, Homo sapiens
HVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36 - protein, 206 aa, Homo sapiens
ASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 37 - protein, 450 aa, Homo sapiens
HIQLLQSGPQVKKSGDTVRISCETSGYNFVDSRIHWVRQTPEKRLRWMGWINPLQGGVNYAPEFQGRIRMTRDTFIDTVYVDLSGLTPADTAYYYCARGIDGKSYPFHFWGHGTRVTVFSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 38 - protein, 203 aa, Homo sapiens
RFALTQPASVSGSPGQTITITCAGGSVSWFHFPPGKTPRLIIYESSKRPSGVSPRFSGSQSGSTASLIISGLQSDDEGTYFCSILEFFGRGTLVTVLSQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 39 - protein, 453 aa, Homo sapiens
QVRLVQSGAGARKTGASMKLSCSTSGYTFTTHHGHFINWVRQARGQGLEWMGWMNPMTGQMNIEGKFQGRVTLTRDIYSDTAYMEMTRLTTGDTGTYYCARGDFGQNYPFHYWGQGSLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40 - protein, 206 aa, Homo sapiens
LSALTQPASVSGSPGQSVTISCSGTNRYLVSWYQQHPDKAPKLIIYDDNKRPSGISDRFSASRPDDTASLTISGLQTGDEATYWCASYERFGGGTRLTVLSQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 41 - protein, 450 aa, Homo sapiens
HVQLVQSGGGVKKIGAAVRISCEVSGYNFMDQFINWVRQAPGQGLEWMGWMNPIYGQVNYSWRFQGRVTMTRDMYTDTAFMELRGLRVDDTAVYYCARGPSGENYPFHYWGQGVRVVVSSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 206 aa, Homo sapiens
ASALTQPASMSASPGQSVTISCSGTRHIISAWFQQYPGKPPKLIIFDDDKRPSGVPSRFSASRPGDTASLTISNVQPEDEATYICNTYEFFGGGTKLTVLSQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 43 - protein, 450 aa, Homo sapiens
HIQLLQSGPQVKKSGDTVRISCETSGYNFVDSRIHWVRQTPEKRLRWMGWINPLHGGVNYAPEFQGRIRMTRDTFIDTVYVDLSGLTPADTAYYYCARGIDGKSYPFHFWGHGTRVTVFSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44 - protein, 203 aa, Homo sapiens; identical to SEQ ID NO: 38

SEQ ID NO: 45 - protein, 455 aa, Homo sapiens
RVTLQQSGAIVRQPGASVTVSCETSGYTFTKYFIYWVRQAPGQGLEWLGRIHPRTGAVKYAPRFQGRLSMTRDWSLDTAYLGLTGLTLGDTALYFCARGAFEADSYGSSYPFHHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 46 - protein, 207 aa, Homo sapiens
SWALTQPASVSASPGQSVTMSCTGFGNYNPDSWYQQYPGKAPKLIIYEDNKRPSGVSDRFSASRLGSTSSLTISNVQAADDAHYVCASFEFFGGGTKLTVLSQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 47 - protein, 455 aa, Homo sapiens
RVTLQQSGATVKQPGASVTVSCETSGYTFTKYTIHWVRQAPGQGLQWVGRIHPRTGAVKYAPIFQGKVSMSRDLSRDTAYLGLTRLTLADTALFFCARGAFEADLSGPTYPFHHWGQGTLVIVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 48 - protein, 207 aa, Homo sapiens
SWALTQPASVSASPGQSVTMSCTGFGNYNPDSWYQQYPGKAPKLIIYEDNKRPSGVSNRFSASRLGSTSSLTISNVQAADDAHYVCASFEFFGGGTKLIVLSQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 49 - protein, 450 aa, Homo sapiens
NVQLMQSGTEVKKSGASVTISCETAGFNFIDSVIHWLRQAPGGGFQWMGWIKPLRGAVNYPQFLQGRVSMTRDLSTDTVYMVLNGLTPDDTGLYYCAKGAFRGGSPFGFWGQGTLLTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 50 - protein, 202 aa, Homo sapiens
QSALSQPVSVSGSPGESITISCTGATTWYQQLPGRPPKLIIYDVTNRPSGISSRFSGSTSGHTASLTISGLQVDDEGLYHCASREFFGGGTKLTVLSQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 51 - protein, 450 aa, Homo sapiens
QVRLVQSGPQVKKTGASVRVSCETSGYTFTSYFIHWLRLGPGEGLQWMGWINPLHGAVNYENKFRGRVTITRDTSTDTVYLDMSRLTPDDTAVYFCTRGIVADGWPYGHWGQGTQVTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 52 - protein, 203 aa, Homo sapiens
SWALTQPASVSGSPGQSVAISCAGGSVSWYQVLPGRAPKLIIYEGAKRPSGVSARFSGSQSGNTAYLTISDLQTEDEGIYFCSSLQFFGGGTKLTVLSQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 53 - protein, 451 aa, Homo sapiens
QVRLQQSGVVVRKPGASVRISCETSGFTFIDHIVHWVRRAPGRGFEWMGWIKPLRGAVDYAPQLRGRISLTRDIYSETVFIDVSRLTSGDTAIYFCCKAAAPEEAFPLQYWGQGTQLIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 54 - protein, 205 aa, Homo sapiens
QAALTQPASVSGSPGQSVTISCLYANVDICWYQLHPGRAPKLLIVDNNKRPSGVSPRFSGSKSGTTASLTISGLQADDEAEYHCSSRTFFGGGTKLTVLSQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 55 - protein, 451 aa, Homo sapiens
QVRLQQSGVVVRKPGASVRLSCETSGFKFIDHIVNWVRRAPGRGFEWMGWIKPLGGVADYAPQHRGRISLTRDIYTETVFIDLSRLTSGDTAIYFCCKAAAPDEAFPLEYWGQGTQLIVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 205 aa, Homo sapiens
QAALTQPASVSGSPGQSVTISCLYANVDICWYQIQPGRLPKLLIVDNNRRPSGVSPRFSGSKSGTTASLTISGLQADDEAEYHCSSTTFFGGGTKLTVLSQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 57 - protein, 451 aa, Homo sapiens
QVRLVQSGPVMRKPGASVRISCETSGFAFLDHIVHWVRRAPGRGFEWMGWVKTIGGVVDYAPHLRGRISVTRDVFSETVFLDLSRLTSGDTAMYFCSKAAAPDEAFPLEFWGQGTQVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 58 - protein, 205 aa, Homo sapiens
QAALTQPASVSGSPGQSVTISCLYANVDICWYQLHPGRAPKLLILDNNKRPSGVSSRFSGSKSGTTASLTISDLQADDEAEYHCSSTTFFGGGTRLTVLSQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 59 - protein, 451 aa, Homo sapiens
QVRLVQSGPVVRKPGTSVRISCETSGFAFLDHIVHWVRRAPGRGFEWMGWVKTIGGVVDYAPHLRGRISVTRDVFSEIVFMELSRLTSGDTAMYFCSKAAAPDEAFPLEFWGQGTQVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 60 - protein, 205 aa, Homo sapiens
QAALTQPASVSGSPGQSVTISCLYANVDICWYQLHPGRAPKLLIVDNNKRPSGVSSRFSGSKSGTTASLTISDLQADDEAEYHCSSTTFFGGGTRLTVLSQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 61 - protein, 450 aa, Homo sapiens
QVQLVQSGAGVKKPGASVRVSCETSGFKFTEYFIHFLRQAPGQGLEWMGWLNPLRGAVNYPRKFQGRVTLTRDIYTTTVYMQLNGLTPDDTAVYYCARAVFNEAFPFDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 62 - protein, 204 aa, Homo sapiens
SWAQTQPASVSGSPGQSITISCAGIVSDAWYQQYPGRPPRLILYDGDKRPSGVSPRFSASRAGKTASLTISGLQADDEAYYHCASREFFGGVTKLTVLSQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 63 - protein, 451 aa, Homo sapiens; identical to SEQ ID NO: 55

SEQ ID NO: 64 - protein, 205 aa, Homo sapiens
QAALTQPASVSGSPGQSVTISCLYANVDICWYQIQPGRLPKLLIVDNDRRPSGVSPRFSGSKSGTTASLTISGLQADDEAEYHCSSTTFFGGGTKLTVLSQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 65 - protein, 451 aa, Homo sapiens; identical to SEQ ID NO: 57

SEQ ID NO: 66 - protein, 205 aa, Homo sapiens; identical to SEQ ID NO: 58

SEQ ID NO: 67 - protein, 450 aa, Homo sapiens
HVQLRQSGTEAKKSGASVTISCETAGFNFIDSVIHWLRQAPGGGFQWMGWIKPLRGGVNYPHYLQGRISMTRDLSSDTVYMVLNRLTPADTGLYYCAKGAFGGSSPFGFWGQGTLLTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 68 - protein, 202 aa, Homo sapiens
QSALSQPVSVSGSPGESITISCTEATTWYQQLPGKPPKLIIYDVTNRPSGISSRFSGSMSGRTASLTISGLQVDDEGLYHCASREFFGGGTKLTVLSQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 69 - protein, 450 aa, Homo sapiens
HVQLMQSGTQAKKSGASVTISCETAGFKFIDSVIHWLRQAPGGGFQWMGWIKPLGGAVNYPPYLQGRISLTRDLSTDTIYMVLNGLTPADTGFYYCAKGAFGGGSPFGFWGQGTLLTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 70 - protein, 202 aa, Homo sapiens
QSALSQPVSVSGSPGDSITISCFGATTWYQQLPGRPPKLIIYDVTNRPSGISGRFSGSMSGQKASLTISGLQVDDEGLYHCASREFFGGGTKLTVLSQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 71 - protein, 450 aa, Homo sapiens
HVQLRQSGTEAKKSGASVTISCETAGFNFIDSVIHWLRQAPGGGFQWMGWIKPLRGGVNYPHYLQGRISMTRDLSSDTVYMVLNRLTPDDTGLYYCAKGAFGGSSPFGFWGQGTLLTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 72 - protein, 202 aa, Homo sapiens
QSALSQPVSVSGSPGESITISCTEATTWYQQLPGRSPKLIIYDVTNRPSGISSRFSGSMSGRTASLTISGLQVDDEGLYHCASREFFGGGTKLTVLSQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 73 - protein, 455 aa, Homo sapiens
RVTLQQSGATVRQPGASVTVSCETSGFTFIKYTIHWVRQAPGQGLQWVGRIHPRTGAVKFAPIFQGKFSMSRDLSRDTAYLGLTRLTLADTALFFCARGAFEADLYGPTYPFHHWGQGTQVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 74 - protein, 207 aa, Homo sapiens
SWALTQPASVSASPGQSVTMSCTGFGSYNPDSWYQQYPGKAPKLIIYDDNKRPSGVSDRFSASRLGSTSSLTISNVQAADDAHYVCASFEFFGGGTKLTVLSQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 75 - protein, 450 aa, Homo sapiens
HIQLLQSGPQVKKSGDTVRISCETSGYNFVDSLIHWVRQTPEKRLRWMGWINPLQGGVNYAPEFQGRIRMTRDTFIDTVYVDLSGLTPADTAYYYCARGIDGNSYPFHFWGHGTRVTVFSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 76 - protein, 203 aa, Homo sapiens
RFALTQPASVSGSPGQTITITCAGGSVSWFHFPPGKTPRLIIYESSKRPSGVSPRFSGSQSGSTASLIISGLQSDDEGTYFCSILEFFGRGTLLTVLSQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 77 - DNA, 1374 bp, Homo sapiens
gcgggactgatgcagtctggggctgtgatgaagaattcgggggcctcagtgagggtctcttgtcaggctgatggatacgacttcattgactatgtcattcactggtttcgacaaagacgtggagaaggtcttgagtggctgggatggatgaatccctcgggaggcggcacaaactatccgcgaccatttcagggcaaagtcaccatgaccagggacacgtccaccgagacagcctatttagatgtcagaggacttacatatgacgacacggccgtctattattgtgtgagagacagggccaacggttcgggaagaagacgttttgagtcggtgaattggttcctggatctgtggggccgcggcacccaaataacagtcgtctcgccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 78 - DNA, 615 bp, Homo sapiens
cagtctgccctaactcagcctcgctcagtgtccgcatctcctggtcagtcagtcaccatctcctgcactggaacacacaattatgtgtcctggtgtcaacagaaaccgggccaagcccccaaattattaatttacgatttcaataaacggccctcaggggtctctgatcgcttctctggctccacgtctggcaacacggcctccctgaccatctctggactccaggctgacgatgagggtcattatttttgttgggcgtttgaaaatatcggcggagggaccaagctgaccgtcctgcgtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 79 - DNA, 1371 bp, Homo sapiens
gcggacttggtgcagtctggggctgtggtgaagaagcctggggactcagtgaggatctcctgtgaggctcaaggatatagatttcctgactacatcattcactggattcgacgggcccctggacaaggccctgaatggatgggatggatgaatccaatgggcggacaagtaaatattccatggaaatttcagggtagggtctccatgacccgggacacgtccatcgaaacagcatttctggacttaagaggactaaagtctgacgacacggccgtctattattgcgtgagagatcgcagtaatggatcgggaaagcgattcgagtcctccaattggttcctcgatctgtggggccgtgggactgcggtcacaattcaatcatcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 80 - DNA, 615 bp, Homo sapiens
cagtctgccctgactcagcctcgctcagtgtccgcatctcctgggcagtccgtcaccatttcctgcactggaacccacaatttggtctcttggtgtcaacatcagccaggcagagcccccaaattattaatttatgacttcaataagaggccctcaggggtccctgatcgcttctctggctccgggtctggcggcacggcctccctgaccatcactggactccaggatgacgatgacgccgaatatttttgttgggcgtatgaagcttttggcggagggaccaagttgaccgttcttcgtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 81 - DNA, 1371 bp, Homo sapiens
gcggacttggtgcagtctggggctgtggtgaagaagcctggggactcagtgaggatctcctgtgaggctcaaggatacaaatttcctgactacatcattcactggattcgacgggcccctggacaaggccttgagtggatggggtggattaatccaatgggcggacaagtaaacattccatggcagtttcagggcagggtctccatgacccgggacacgtccatcgaaacagcatttctggacttaagaggactaaagtctgacgacacggccctctattattgcgtgagagatcgaagtaatggatcgggaaggcgattcgagtcctccaattggttcctcgatctgtggggccgcggcactgcggtcactgttcattcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 82 - DNA, 615 bp, Homo sapiens
cagtctgccctgactcagcctcgctcagtgtccgcatctcctgggcagtccgtcaccatttcctgcactggaacccacaatttggtctcttggtgtcaacatcacccaggcagagcccccaaattattaatttatgacttcaataagaggccctcaggggtccctgatcgcttctctggctccgggtctggcggcacggcctccctgaccatcagtggactccaggatgacgatgacgccgaatatttttgttgggcgtatgaagcttttggcggagggaccaagttgaccgtacttcgtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 83 - DNA, 1374 bp, Homo sapiens
tcggcggaattggtgcaatctggggctgtggtgaagaagcctgggacctccgtgaaggtctcttgtcaggcttatggatacacttttaccgactaccttattcattggcttcgacaggcccctggacaaggacttgaatggatgggatggatgaatcctgtttatggacaagtaaattatgcccaaaactttcagggcagggtctccatgaccagggacatttacagggaaacagcatttctagaggtgcgcgacctgaagactgacgacacaggcacttattattgtgtgagagacacaggcgacggttcgcggagacactttgactccatcaattggtttctcgatctttggggccgcgggacatggataagggtcgccccagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 84 - DNA, 615 bp, Homo sapiens
cagtgtgtcttgactcagcctcgctcagtgtccggatctcctggacaatcagtcaccatctcctgcactggaactcacaattatgtctcctggtgtcaacaccacccaggcaacgcccccaaattattactttatgatttcgacaagcggccctcaggaatctctgatcgcttctctggctctaggtctggcaacacggcctccctgaccatctctggcctccagcctgaggatgaggccgattacttttgttgggcctttgaagcctttggcggagggaccaaggtgctcgtccttcgtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 85 - DNA, 1371 bp, Homo sapiens
gcggacttggtgcagtctggggctgtgatgaagaagcctggggactcagtgagaatctcctgtgaggctcgaggatacacattcactgactacgtcattcactggattcgacgggcccctggacaaggccttgaatggatggggtggattgatccaccttatggacaagtaaatattccatggaattttcagggcagggtctccatgacccgggacacgtccatcgaaacagcatttctggacttaagaggtctaaagtctgacgacacgggcctctattattgcgtgagagatcgaagtaatggatggggaaagcgattcgagtcctccaattggttcctcgatctgtggggccgcggcactgtggtcactgttcactcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 86 - DNA, 615 bp, Homo sapiens
cagtctgccctgactcagcctcgctcagtgtccgcatctcctgggcagtccgtcaccatttcctgcactggaacccacaatttggtctcttggtgtcaacatcacccaggcagagcccccaagttattaatttatgacttcaataagaggccctcaggggtccctgatcgcttctctggctccgggtctggcggcacggcctccctaaccatcagtggactccaggatgacgatgacgccgaatatttttgttgggcatatgaagctttcggcggagggaccaagttgactgtacttcgtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 87 - DNA, 1371 bp, Homo sapiens
gcggacttggtgcagtctggggctgtggtgaagaagcctggggactcagtgagaatctcctgtgaggctcaaggatacacattcactgactacgtcattcactggattcgacgggcccctggacaaggccttgaatggatggggtggattaatccaggttatggacaagtaaatattccatggaactttcagggcagggtctccatgacccgagacacgtccatcgaaacagcatttctggacttaagaggtctaaagtctgacgacacgggcctctattattgcgtgagagatcgaagtaatggatggggaaagcgattcgagtcctccaattggttcctcgatctgtggggccgcggcactgtggtcactgttcactcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 88 - DNA, 615 bp, Homo sapiens
cagtctgccctgactcagcctcgctcaatgtccgcatctcctgggcagtccgtcaccatttcctgcactggaacccacaatttggtctcttggtgtcaacatcacccaggcagaccccccaaattattaatttatgacttcaataagaggccctcaggggtccctgatcgcttctctggctccgggtctggcggcacggcctccctgaccatcagtggactccaggatgacgatgacgccgaatacatttgttgggcatatgaagctttcggcggagggaccaagttgaccgtacttcgtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 89 - DNA, 1371 bp, Homo sapiens
gcggacttggtgcagtctggggctgtggtgaaaaatgctggggcctcagtgagggtctcctgtgaggcttatggatacacattcgtggactacttcattcattgggtccgacaggcccctggacaaggctttgaatggatgggatacatggatcccttgaacgggcgcccaaacattgcgcgaaaatttcagggcaggctctccctgagtcgagataggtccagcgaaacttcatttctggacttaagtggactgaggtctgacgactcggccgtctattattgtgtgagagacaagagtaatggatcgggcagacggtttgactcgtctaattggtttctcgatctgtggggccgtggaacccgggtcagtattttctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 90 - DNA, 615 bp, Homo sapiens
cagtctgccctgactcagcctcgctcagtgtccgcaactcctggacagtcagtcaccatctcctgcactggaacccacaattatgtctcttggtgtcaacaacatccaggcagagcccccaaattactaatttatgacttcaataagaggccctcaggggtcccggatcgcttctctggctccggatctggcggcacggcctccctaaccatcactggactccaggatgacgatgaagcggactatttttgttgggcctatgatgcttttggcggagggaccaagttgaccgtcctgcgtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 91 - DNA, 1371 bp, Homo sapiens
gcggacttggtgcagtctggggctgtggtgaagaagcctggggactcagtgagggtctcctgtgaggcttatggatacacattcagtgactacatcattcattggattcgacgggcccctggacgaggccttgaatggatgggatggatgaatccgatgggcggacaagtgaatattccgtggaactttcaggggagagtctccatgacccgggacacgtccatcgaaacagcatttctggacttaagaggactgaggtctgacgacacggccgtctattactgtgtgagagatcgcagcaatggatcgggcaagcgatttgagtcctccaattggttcctcgatctgtggggccgcgggaccgcggtcactatttcctcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 92 - DNA, 615 bp, Homo sapiens
cagtctgccctgactcagcctcgctcagtgtccgcagctcctggacagtccgtcaccatttcctgcactggaacccacaatttggtttcttggtgtcaacatcacccaggcagagcccccaagttattaatttatgacttcaataagagaccctcaggtgtccctgatcgtttctctggctccgggtctggcggcacggcctccctaaccatcactggactccaggatgacgatgaggctgaatatttttgttgggcgtatgaagtttttggcggagggaccaagttgaccgtgcttcgtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 93 - DNA, 1371 bp, Homo sapiens
gcggacttggtgcagtctggggctgtggtgaagacgcctggggcctcagtgagggtctcctgtgaggcttatggatacacattcattgactacatcattcattgggtccgacaggcccctggacaaggttttgaatggctgggatacatcgatcctatgaacgggcgcccaaacattgcgcgaaaatttcagggcaggctctccctgagccgggatacgtccatcgaaacatcatttctggacttaagtggactgaggtctgacgactcggccgtctattattgtgtgagagacaagagtaatggatcgggcaaacgatttgactcctctaattggtttctcgatctgtggggccgtggaacgcgggtcagcatttcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 94 - DNA, 615 bp, Homo sapiens
cagtctgccctgactcagcctcgctcagtgtccgcagctcctggacagtcagtcaccatctcctgcactggaacccacaattatgtctcttggtgtcaacaacatccaggcagagcccccaaattactaatttatgacttcaataagaggccctcaggggtcccggatcgcttctctggctccggatctggcggcacggcctccctaaccatcactagactccaggatgacgatgacgctgactatttttgttgggcgtatgatgcttttggcggagggaccaagttgaccgtcctgcgtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 95 - DNA, 1371 bp, Homo sapiens
gcggacttggtgcagtctggggctgtggtgaagaagcctggggcctcagtgagggtctcctgtgaggcttatggatacacattcactgactacatcattcattggattcgacaggcccctggacaaggccttgaatggatgggatggatgaatcctatgggcgggcgcacaaatattccgtggaaatttcagggcagggtctccatgacccgggacacgtccatcgaaacagcatttctggacttaagtggactaacgtctgacgacacggccgtctattattgcgtgagagacaagagtaatggatcgggcaaacgatttgactcctctaattggttcctcgatctgtggggccgcggaaccccggtcactatttcctcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 96 - DNA, 615 bp, Homo sapiens
cagtctgccctgactcagcctcgctcagtgtccgcagctcctggacagtccgtcaccatttcctgcactggaacccacaatttggtctcttggtgtcaacaacacccaggcagagcccccaaattattaatttatgacttcaataagaggccctcaggggtccctgatcgcttctctggctccgggtctggcggcacggcctccctaagtatcactggactccaggatgacgatgaagctgaatatttttgttgggcgtatgaagcttttggcggagggaccaagttgaccgtccttcgtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 97 - DNA, 1371 bp, Homo sapiens
gcggacttggtgcagtctggggctgtggtgaagaagcctggggcctcagtgcgggtctcctgtgaggcttatggatatacattcgttgactacctcattcattgggtccgacaggcccccggacaaggttttgaatggatgggatacatggatcctatgaacgggcgcccaaatattgcgcgaaaatttcagggcaggctctccctgagccgagatacgtccatcgaaacatcatttctggacttaagtggactgaggtctgacgactcggccgtctattattgtgtgagagacaagagtggtggatcgggcaaactatttgactcctctaattggtttctcgatctgtggggccgtggaacccgggtcagcatttcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 98 - DNA, 615 bp, Homo sapiens
cagtctgccctgactcagcctcgctcagtgtccgcagctcctggacagtcagtcaccatctcctgcaccggaactcacaattatgtctcttggtgtcaacaacatccaggcagagcccccaaattactaatttatgacttcaataagaggccctcaggggtcccggatcgcttctctggctccggatctggcggcacggcctccctaaccatcactggactccaggatgacgatgacgctgattatttttgttgggcgtatgatgcttttggcggagggaccaagttgaccgtcctgcgtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 99 - DNA, 1371 bp, Homo sapiens
gcggacttggtgcagtctggggctgtggtgaagaagcctggggactcagtgagaatctcctgtgaggctcaaggatacacattcactgactacgtcattcactggattcgacgggcccctggacaaggccttgaatggatggggtggattaatccaggttatggacaagtaaatattccatggaactttcagggcagggtctccatgacccgagacacgtccatcgaaacagcttttctggagttaagaggtctaaagtctgacgacacgggcctctattattgcgtgagagatcgaagtaatggatggggaaagcgattcgagtcctccaattggttcctcgatctgtggggccgcggcactgtgattactgttcactcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 100 - DNA, 615 bp, Homo sapiens
cagtctgccctgactcagcctcgctcaatgtccgcatctcctgggcagtccgtcaccatttcctgcactggaacccacaatttggtctcttggtgtcaacatcacccaggcagaccccccaaattattaatttatgacttcaataagaggccctcaggggtccctgatcgcttctctggctccgggtctggcggcacggcctccctgaccatcactggactccaggatgacgatgacgccgaatacatttgttgggcatatgaagctttcggcggagggaccaagttgaccatacttcgtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 101 - DNA, 1371 bp, Homo sapiens
gcggacttggtgcagtctggggctgtggtgaagaagcctggggactcagtgagaatctcctgtgaggctcagggatatacattcaccgactacgtcattcattggattcgacgggcccctggacaaggccttgaatggatggggtggatggatccaagttatggacaagtcaatattccacggaactttcagggcagggtctccatgacccgggacacgttcagggaaacagcatatctggaattaagaggtctacagtctgacgacaagggcctctattattgtgtgagagatcgaagtcacggatcgggaaggcaattcgagtcctccaactggttcctcgatctgtggggccgcggcactgtggtcaatgttcagtcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 102 - DNA, 615 bp, Homo sapiens
cagtctgccctgactcagcctcgctcagtgtccgcatctcctgggcagtccgtcaccatttcctgcactggaacccacaatttggtctcttggtgtcaacatcacccaggcagacctcccaaattattaatttatgacttcaataagagggcttcaggggtccctgatcgcttctctggctccgggtctggcggcacggcctccctgaccattagtggactccaggatgacgatgacgccgaatatttttgttgggcatatgaagctttcggcggagggaccaagttgaccgtacttcgtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 103 - DNA, 1371 bp, Homo sapiens
gcggacttggtgcagtctggggctgtggtgaagaagcctggggactcactgagaatctcctgtgaggctcaaggatacacattcactgactacgtcattcactggattcgacgggcccctggacaaggccttgaatggatgggatggatggatccaagttttggacaaatgaacattccacggaactttcagggcagggtctccatgacccgtgacatgtacatcgaaacagcatttctggacttaagaggtctaaagtctgacgacacgggcctctattattgcgtgagagatcgaagtcatggatcgggaaggctattcgagtcctccaattggttcctcgatctgtggggccgcggcactgtggtcactgttcagtcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 104 - DNA, 615 bp, Homo sapiens; identical to SEQ ID NO: 102

SEQ ID NO: 105 - DNA, 1371 bp, Homo sapiens
gcggacttggtgcagtctggggctgtggtgaagaagcctggggactcagtgagaatctcctgtgaggctcaaggatacagattcactgactacgtcattcattggattcgacgggcccctggacaaggccttgaatggatggggttgatggatccaagttttggacgaatgaatattccacggaaatttcagggcagggtctccatgacccgggacacgtccatggaaacagcatttctggacttcagaggtctaaattttgacgacacgggcctctattattgcgtgagagatcgaagtcatggatcgggaagactattcgagtcctccaattggttcctcgatctgtggggccgcggcactgtggtcactgttcagtcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 106 - DNA, 615 bp, Homo sapiens
cagtctgccctgactcagcctcgctcagtgtccgcatctcctgggcagtccgtcaccatttcctgcactggaacccacaatttggtctcttggtgtcaacatcacccaggcagacctcccaaattattaatttatgacttcaataagagggcatcaggggtccctgatcgcttctctggctccgggtctggcggcacggcctccctgaccatcagtggactccaagatgacgatgacgccgaatatttttgttgggcatatgaagctttcggcggagggaccaagttgaccgtacttcgtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 107 - DNA, 1371 bp, Homo sapiens
ccggacttggtgcagtctggggctgtggtgaagaagcctggggactcagtgagaatttcctgtgaggctcaaggatacacattcattgactacgtcattcactggattcgacgggcccctggacaaggccttgaatggatggggttgatggatccaacttatggacgaatgaatattccacggaagtttcagggcagggtctccatgacccgggacacgtccatcgaaacagcatttctggacttaagaggtctaaaatctgacgacacgggcctctattattgcgtgagagatcgaagtcatggatcgggaaggctattcgagtcctccaactggttcctggatctgtggggccgcggcactgtggtcactgttcagtcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 108 - DNA, 615 bp, Homo sapiens
cagtctgccctgactcagcctcgctcagtgtccgcatctcctgggcagtccgtcaccatttcctgcactggaacccacaatttggtctcttggtgtcaacatcacccaggcagacctcccaaattattaatttatgacttcaataagagggcttcaggggtccctgatcgcttctctggctccgggtctggcggcacggcctccctgaccatcagtggactccaagatgacgatgacgccgaatatttttgttgggcatatgaagctttcggcggagggaccaagttgaccgtacttcgtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 109 - DNA, 1371 bp, Homo sapiens
gcggacttggtgcagtctggggctgtggtgaagaagcctggggactcagtgaggatctcctgtgaggctcaaggatacagatttcttgactacatcattcactggattcgacgggcccctggacaaggccttgaatggatgggatggatgaatccaatgggcggacaagtaaacattccatggaactttcagggtagggtctccatgacccgggacacgtccatcgaaacagcatttctggacttaagaggactaaagtctgacgacacggccgtctattattgcgtgagagatcgcagtaatggatcgggaaagcgattcgagtcctccaattggttcctcgatctgtggggccgcgggactgcggtcactattcattcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 110 - DNA, 615 bp, Homo sapiens
cagtctgccctgactcagcctcgctcagtgtccgcatctcctgggcagtccgtcaccatttcctgcactggaacccacaatttggtctcttggtgtcaacatcacccaggcagagcccccaaattattaatttatgacttcaataagaggccctcaggggtccctgatcgcttctctggctccgggtctggcggcacggcctccctgaccatcactggactccaggatgacgatgacgccgaatatttttgttgggcgtatgaagcttttggcggagggaccaagttgaccgtacttcgtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 111 - DNA, 1350 bp, Homo sapiens
cacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgagggggccctctggggaaaattatccttttcactattggggccagggtgtccgagtggtcgtctcgtcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 112 - DNA, 618 bp, Homo sapiens
gcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 113 - DNA, 1350 bp, Homo sapiens
cacattcagttgctacagtcggggcctcaagttaagaagtctggggacacagtgagaatctcctgtgagacctctggatataacttcgtcgactcccgtatccactgggtccgacagaccccggaaaaacgtctcagatggatgggctggatcaatcctctccaaggtggtgtgaattacgcgccggaatttcagggcagaatcaggatgaccagggacacatttatagacacagtttacgtggacctgagcggactgacaccggccgacacggcctattattactgcgcgcgagggatcgatggcaagtcttacccctttcatttctggggccacggaacccgggtcaccgtcttctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 114 - DNA, 609 bp, Homo sapiens
cgatttgccctgactcaacctgcctccgtgtctgggtctcctggacagacgatcaccataacctgcgctggaggcagcgtctcctggtttcatttccctccaggcaaaacccccagactcattatttatgagtcttctaagcgaccctctggggtctctcctcgattctctgggtcccagtctggcagcacggcctcccttataatttctggcctccagtctgatgacgaagggacatacttctgttctattcttgaatttttcggcagagggactcttgtcaccgtcctgagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 115 - DNA, 1359 bp, Homo sapiens
caggtgcgcttggtgcagtctggggctggggcgaggaagactggggcctcaatgaaactttcctgctcgacctctggatacaccttcaccactcatcacggccacttcataaattgggtgcgacaggcccgtggacaagggcttgagtggatggggtggatgaatcccatgactgggcagatgaatattgaggggaaatttcagggcagagtcaccctcactcgagacatatacagtgacacggcttacatggaaatgaccagactgacaactggcgacacgggcacttattactgtgcgcgaggcgatttcggacagaattatccctttcattattggggccagggaagcctggtcatcgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 116 - DNA, 618 bp, Homo sapiens
ctgtctgccctgactcagcctgcctccgtgtctgggtctcctgggcagtcggtcaccatctcctgctctggaacgaaccgttaccttgtctcctggtatcaacaacaccctgacaaagcccccaaactcatcatttatgacgacaataagcggccctcaggaatttctgatcgcttctcagcctccaggcctgacgacacggcctccctgacaatctctggactccagactggggacgaggctacttattggtgtgcctcatatgaacgttttggcggcgggacgaggctgaccgtccttagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 117 - DNA, 1350 bp, Homo sapiens
cacgtccaattggtgcagtctggaggtggggtgaagaagattggggccgctgtgaggatctcctgcgaggtgtctggatacaacttcatggaccaattcataaattgggtgcgacaggcccccggtcagggccttgagtggatgggatggatgaacccaatatatggacaagtaaattattcatggagatttcaaggaagggtcaccatgaccagggacatgtacaccgacacggccttcatggagttgagaggactgagagtggacgacacggccgtctattattgcgcgagggggccctctggggaaaattatccttttcactattggggccagggtgtccgagtggtcgtctcgtcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 118 - DNA, 618 bp, Homo sapiens
gcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacatacatttgcaatacatatgaattctttggcggagggaccaaattgaccgtcctaagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 119 - DNA, 1350 bp, Homo sapiens
cacattcagttgctacagtcggggcctcaagttaagaagtctggggacacagtgagaatctcctgtgagacctctggatataacttcgtcgactcccgtatccactgggtccgacagaccccggaaaaacgtctcagatggatgggctggatcaatcctctccacggtggtgtgaattacgcgccggaatttcagggcagaatcaggatgaccagggacacatttatagacacagtttacgtggacctgagcggactgacaccggccgacacggcctattattactgcgcgcgagggatcgatggcaagtcttacccctttcatttctggggccacggaacccgggtcaccgtcttctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 120 - DNA, 609 bp, Homo sapiens
cgatttgccctgactcaacctgcctccgtgtctgggtctcctggacagacgatcaccataacctgcgctggaggcagcgtctcctggtttcatttccctccaggcaaaacccccagactcattatttatgagtcttctaagcgaccctctggggtctctcctcgattctctgggtcccagtctggcagcacggcctccctcataatttctggcctccagtctgatgacgaagggacatacttctgttctattcttgaatttttcggcagagggactcttgtcaccgtcctgagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 121 - DNA, 1365 bp, Homo sapiens
cgtgttacattacaacaatctggggctatagtgaggcagcctggggcctcagtgaccgtctcctgcgagacttctggatatactttcaccaagtatttcatctactgggtgcgacaggcccctggacagggtcttgagtggctgggcagaatacacccccgaaccggtgccgtgaagtatgcaccgagatttcagggtagactgtccatgaccagagactggtcactcgacacagcctacctcggattgaccggactgacactcggcgacacggctctatatttctgtgcgaggggggcctttgaggcagattcatatgggtcaagttatccctttcaccactggggccagggaaccctagtcaccgtctccgcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 122 - DNA, 621 bp, Homo sapiens
tcctgggccctgactcaacccgcctccgtgtctgcgtctcctgggcagtcggtcaccatgtcctgcactggattcggaaattataaccctgactcctggtaccaacaatacccaggcaaagcccccaaactcatcatttatgaagacaataaaagaccctcgggggtctctgatcgcttctctgcctccagacttggcagcacgtcttccctgacaatctctaacgtccaggctgcggacgacgcccattatgtctgcgcctcctttgaatttttcggcggagggaccaagctgaccgtcctgagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 123 - DNA, 1365 bp, Homo sapiens
cgtgtgacattacaacaatctggggctacagtgaagcagcctggggcctcagtgaccgtctcctgcgagacttctggatacactttcaccaagtataccattcactgggtgcgacaggcccctggacagggtcttcagtgggtgggcagaatacacccccgaaccggtgccgtgaagtatgcaccgatatttcagggtaaagtgtccatgagtcgagacttgtcacgcgacacagcctacctcggattgaccagactgacgctcgccgacacggctctatttttctgtgcgaggggggcctttgaggcagatttaagtgggccaacttacccctttcaccactggggccaaggaaccctagtcatcgtctccgcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 124 - DNA, 621 bp, Homo sapiens
tcctgggccctgactcaacccgcctccgtgtctgcgtctcctgggcagtcggtcaccatgtcctgcactggattcggaaattataaccctgactcctggtaccaacaatacccaggcaaagcccccaaactcatcatttatgaggacaataaaagaccctcgggagtctctaatcgcttctctgcctccagacttggcagcacgtcttccctgacaatctctaacgtccaggccgctgacgacgcccattatgtctgcgcctcctttgaatttttcggcggagggaccaagctgatcgtcctgagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 125 - DNA, 1350 bp, Homo sapiens
aacgtgcagttgatgcagtctgggactgaggtgaagaagtctggggcctcggtgacaatctcttgtgagaccgctggattcaacttcatcgactccgtcatacactggctgcgccaggcccctggaggaggatttcagtggatggggtggatcaagcctcttagaggtgccgtcaattatccacagtttttgcagggcagggtctccatgacccgggacttgtccaccgacacggtgtacatggtcttgaatggactgacacctgacgacacaggcctttattactgcgcgaaaggggcctttagagggggttctccctttggcttctggggccagggaactctgctcaccgtctccccagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 126 - DNA, 606 bp, Homo sapiens
cagtctgccctgtctcagcctgtctccgtgtctgggtctcctggagagtcgatcaccatttcctgtactggagccaccacctggtatcaacaactcccaggcagaccccccaaactcatcatttatgacgtcactaaccggccctcaggcatttctagtcgtttctctggctccacgtctggccacacggcctccctgacaatctccggtctccaggttgacgacgagggtctgtatcactgcgcctcacgtgaatttttcggcggagggaccaagctgaccgtcctgagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 127 - DNA, 1350 bp, Homo sapiens
caggtgcgactggtgcagtctgggcctcaggtgaagaagactggggcctcagtgagggtctcctgcgaaacctctggatacacgttcacctcctacttcatccattggttacgactgggccccggagaggggcttcagtggatggggtggatcaaccctttacatggtgccgtgaattatgaaaacaaatttaggggcagggtcacaatcaccagggacacgtccacagacacagtgtatttggacatgagcagactgacccctgacgacacggccgtctatttctgcacaagaggaatcgttgctgatgggtggccctatggccactggggccagggaacccaagtcaccgtctccccggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 128 - DNA, 609 bp, Homo sapiens
tcctgggccctgactcagcctgcctccgtgtctgggtctcctggacagtcggtcgccatctcctgcgctggcggcagcgtctcctggtaccaggtgctcccaggcagagcccccaaactcatcatttatgagggcgctaagcgaccctcaggggtttctgctcgcttctctggctcccagtctggcaacacggcttacctgacaatttctgacctccagactgaggacgagggcatctacttctgctcttcacttcaattcttcggcggagggaccaaactgaccgtcctaagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 129 - DNA, 1353 bp, Homo sapiens
caggtgcgacttcagcagtctggtgtcgtggtgaggaagcctggggcctcagtgagaatttcctgcgagacttctggattcaccttcatcgaccacattgtccattgggtgcggcgggcccctggacgaggctttgaatggatgggttggatcaagcctcttaggggtgccgtagattatgcaccccaacttcggggcaggatctccctgacgagggacatttacagtgaaaccgtctttatagacgtgagtcgactgacgtctggcgacacggcgatatacttttgttgtaaggccgccgcccctgaagaagcattcccccttcaatactggggccaggggacccaacttatcgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 130 - DNA, 615 bp, Homo sapiens
caggctgccctgactcagcccgcctccgtgtccggctctcctggacagtcggtcaccatttcctgcctttatgccaatgtagatatctgctggtatcaactacacccgggcagagcccccaaacttctaattgttgacaataataagcggccctcaggagtctctcctcgcttctctggctccaagtctggcaccacggcctccctgacaatctctggacttcaggctgacgacgaggctgaatatcactgctcttcaagaacattttttggcggggggaccaagttgaccgtcctgagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 131 - DNA, 1353 bp, Homo sapiens
caggtgcgacttcagcagtctggtgtcgtggtgaggaagcctggggcctcagtgagactttcctgcgagacgtctggattcaaattcatcgaccacattgtcaactgggtgcggcgggcccctggacgaggctttgaatggatgggttggatcaagcctcttgggggtgtcgctgattatgcaccccaacatcggggcaggatctcactgacgagggacatttacactgaaaccgtctttatagacctgagtcgactgacgtctggcgacacggcgatttatttctgttgtaaggccgccgcccctgatgaagcattcccccttgaatactggggccaggggacccaacttatcgtctccccggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 132 - DNA, 615 bp, Homo sapiens
caggctgccctgactcagcccgcctccgtgtccggctctcctggacagtcggtcaccatttcctgcctttatgccaatgtagatatctgctggtatcaaatacagccgggcagattacccaaacttctgattgttgacaataataggcgaccctcaggagtctctcctcgcttctctggctccaagtctggcaccacggcctccctgacaatctctggacttcaggctgacgacgaggctgaatatcactgctcttcaacaacattttttggcggggggaccaagttgaccgtcctcagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 133 - DNA, 1353 bp, Homo sapiens
caggtgcgacttgtgcagtctggtcccgtgatgagaaagcctggggcctcagtgagaatttcttgcgagacatctggattcgccttcttggaccacattgtccactgggtgcggcgggcccctggacgcggctttgaatggatgggttgggttaagaccattgggggtgtcgttgattatgcaccccaccttaggggcaggatctccgtgacgagagacgtctttagtgaaaccgtctttctggacttgagtcgactgacgtctggcgacacggcgatgtatttttgttctaaggccgccgcccctgacgaagccttcccccttgaattttggggccaggggacccaagtcatcgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 134 - DNA, 615 bp, Homo sapiens
caggctgccctgactcagcccgcctccgtgtccggctctcctggacagtcggtcaccatttcttgcctttatgccaatgtggatatctgctggtatcaacttcacccgggcagagcccccaaacttcttattcttgacaataataaacggccctcaggagtctctagtcgcttctccggttccaagtctggcaccacggcctccctaaccatctctgaccttcaggctgacgacgaggctgaatatcactgctcttcaacaacattttttggcggggggaccaggttgaccgtcctgagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 135 - DNA, 1353 bp, Homo sapiens
caggtgcgacttgtgcagtctggtcccgtggtgagaaagcctgggacctcagtgagaatttcttgcgagacatctggattcgccttcttggaccacattgtccactgggtgcggcgggcccctggacgcggctttgaatggatgggttgggttaagaccattgggggtgtcgttgattatgcaccccaccttaggggcaggatctccgtgacgagggacgtatttagtgaaatcgtctttatggagttgagtcgactgacgtctggcgacacggcgatgtatttttgttctaaggccgccgcccctgacgaagccttcccccttgaattttggggccaggggacccaagtcatcgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 136 - DNA, 615 bp, Homo sapiens
caggctgccctgactcagcccgcctccgtgtccggctctcctggacagtcggtcaccatttcctgcctttatgccaatgtggatatctgctggtatcaacttcacccgggcagagcccccaaacttctaattgttgacaataataagcggccctcaggagtctctagtcgcttctctggttccaagtctggcaccacggcctccctaacaatctctgatcttcaggctgacgacgaggctgaatatcactgctcttcaacaacattttttggcggggggaccaggttgaccgtcctgagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 137 - DNA, 1350 bp, Homo sapiens
caagtgcaactggtgcagtctggggctggggtgaagaagcctggggcctcagtgagggtctcctgcgagacatccggattcaagttcaccgagtactttatccactttttacgacaggcccctggacaagggcttgagtggatgggatggctcaaccctctcagaggtgccgtcaactatccacggaagtttcagggcagagtcactttgaccagggacatctacaccaccaccgtctacatgcaacttaacggtctgacccctgacgacacggccgtctactactgtgccagagcggtctttaatgaagctttcccctttgactactggggccagggaagcctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 138 - DNA, 612 bp, Homo sapiens
tcctgggcccagactcagcctgcctccgtgtctgggtctcctggacagtcgatcaccatctcctgcgctggaatcgtcagtgatgcctggtaccagcaatacccaggcagaccccccagactcatcctttatgacggcgataagcggccctcaggggtttctcctcgtttttctgcctccagggccggcaagacggcctccctgacaatttctgggctgcaggctgacgacgaggcttattatcactgcgcgtcaagggaattttttggaggcgtgaccaagttgaccgtcctaagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 139 - DNA, 1353 bp, Homo sapiens
caggtgcgacttcagcagtctggtgtcgtggtgaggaagcctggggcctcagtgagactttcctgcgagacgtctggcttcaaattcatcgaccacattgtcaactgggtgcggcgggcccctggacgaggctttgaatggatgggttggatcaagcctcttgggggtgtcgctgattatgcaccccaacatcggggcaggatctcactgacgagggacatttacactgaaaccgtctttatagacctgagtcgactgacgtctggcgacacggcgatttatttttgttgtaaggccgccgcccctgatgaagcattcccccttgaatactggggccaggggacccaacttatcgtctccccggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 140 - DNA, 615 bp, Homo sapiens
caggctgccctgactcagcccgcctccgtgtccggctctcctggacagtcggtcaccatttcctgcctttatgccaatgtagatatctgctggtatcaaatacagccgggcagattacccaaacttctgattgttgacaatgataggcgaccctcaggagtctctcctcgcttctctggctccaagtctggcaccacggcctccctgacaatctctggacttcaggctgacgacgaggctgaatatcactgctcttcaacaacattttttggcggggggaccaagttgaccgtcctcagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 141 - DNA, 1353 bp, Homo sapiens; identical to SEQ ID NO: 133

SEQ ID NO: 142 - DNA, 615 bp, Homo sapiens
caggctgccctgactcagcccgcctccgtgtccggctctcctggacagtcggtcaccatttcttgcctttatgccaatgtggatatctgctggtatcaacttcacccgggcagagcccccaaacttctaattcttgacaataataaacggccctcaggagtctctagtcgcttctccggttccaagtctggcaccacggcctccctaaccatctctgaccttcaggctgacgacgaggctgaatatcactgctcttcaacaactttttttggcggggggaccaggttgaccgtcctgagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 143 - DNA, 1350 bp, Homo sapiens
cacgtgcagttgaggcagtctgggactgaggcgaagaagtctggggcctcggtgacaatctcttgtgagaccgctggattcaacttcatcgactccgtcatacactggctgcgccaggcccctggtgggggatttcagtggatggggtggatcaagcctcttagaggtggcgtcaattatccacattatttgcagggcagaatctccatgacccgggacttgtccagtgacacggtttacatggtcttaaatagactgacacctgccgacacaggcctttattactgcgcgaaaggggcctttggggggagttctccctttggcttctggggccagggaactctgctcaccgtctccccagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 144 - DNA, 606 bp, Homo sapiens
cagtctgccctgtctcagcctgtctccgtgtctgggtctcctggagagtcgatcaccatttcctgtactgaagccaccacctggtatcaacaactcccaggcaaaccccccaaactcatcatttatgacgtgaccaaccggccctcaggcatttcaagtcgtttctctggctccatgtctggtcgcacggcctccctgacaatctccggtctccaggttgacgacgagggtctctatcactgtgcctcacgtgaatttttcggcggggggaccaagctgaccgtcctgagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 145 - DNA, 1350 bp, Homo sapiens
cacgtgcaattgatgcagtctgggactcaggcgaagaagtctggggcctcggtgacaatttcttgtgagaccgctggattcaagttcatcgactccgtcatacactggctgcgccaggcccctggagggggatttcagtggatggggtggatcaagcctcttggaggtgccgtcaactatccaccctatttgcagggcaggatctccttgacccgtgacttgtccaccgacacaatttacatggtcttgaatggactgacacctgccgacacaggcttttattactgcgccaaaggggcctttggggggggttctccctttggcttctggggccaggggactctgctcaccgtctccccagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 146 - DNA, 606 bp, Homo sapiens
cagtctgccctgtctcagcctgtctccgtgtctgggtctcctggagactcgatcaccatttcttgttttggagccaccacctggtatcaacaactcccaggcagaccccccaaactcatcatttatgacgtgactaaccggccctcaggcatttcaggtcgtttctctggctccatgtctggtcaaaaggcctccctgacaatctccggtctccaggttgacgacgagggtctctatcactgcgcctcacgtgaatttttcggcggggggaccaaactgaccgtcctgagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 147 - DNA, 1350 bp, Homo sapiens
cacgtgcagttgaggcagtctgggactgaggcgaagaagtctggggcctcggtgacaatctcttgtgagaccgctggattcaacttcatcgactccgtcatacactggctgcgccaggcccctggtgggggatttcagtggatggggtggatcaagcctcttagaggtggcgtcaattatccacattatttgcagggcagaatctccatgacccgggacttgtccagtgacacggtttacatggtcttaaatagactgacacctgacgacacaggcctttactactgcgcgaaaggggcctttggggggagttctccctttggcttctggggccagggaactctgctcaccgtctccccagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 148 - DNA, 606 bp, Homo sapiens
cagtctgccctgtctcagcctgtctccgtgtctgggtctcctggagagtcgatcaccatttcctgtactgaagccaccacctggtatcaacaactcccagggagatcccccaaactcattatttatgacgtgaccaaccggccctcaggcatttcaagtcgtttctctggctccatgtctggtcgcacggcctccctgacaatctccggtctccaggttgacgacgagggtctctatcactgtgcctcacgtgaatttttcggcggggggaccaagctgaccgtcctcagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 149 - DNA, 1365 bp, Homo sapiens
cgtgttacattacaacagtctggggctacagtgaggcagcctggggcctcagtcaccgtctcctgcgagacttctggattcaccttcatcaaatataccattcactgggtgcgacaggcccctggacagggtcttcagtgggtgggaagaatacacccccgaaccggtgccgtgaagtttgcaccgatatttcagggtaaattttccatgagtcgagacttgtcacgcgacacagcctacctcggattgaccagactgacactcgccgacacggctctatttttctgtgcgaggggggcctttgaggcagatttatatgggccaacttacccctttcaccactggggccaaggaacccaagtcaccgtctccgcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 150 - DNA, 621 bp, Homo sapiens
tcctgggccctgactcaacccgcctccgtgtctgcgtctcctgggcagtcggtcaccatgtcctgcactggattcggaagttataatcctgactcctggtaccagcaatacccaggcaaagcccccaaactcatcatttatgatgacaataaaagaccctcgggggtctctgatcgcttctctgcctccagacttggcagcacatcttcactgacaatctctaacgtccaggccgctgacgacgcccattatgtctgcgcctcctttgagtttttcggcggggggaccaagctgaccgtcctgagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 151 - DNA, 1350 bp, Homo sapiens
cacattcagttgctacagtcggggcctcaagttaagaagtctggggacacagtgagaatctcctgtgagacctctggatataatttcgtcgactcccttatccactgggtccgacagaccccggaaaaacgtctcagatggatgggctggatcaatcctctccaaggtggtgtgaattacgcgccggaatttcagggcagaatcaggatgaccagggacacgtttatagacacagtttacgtggacttgagcggactgacaccggccgacacggcctattattactgcgcgcgagggatcgatggcaattcttacccctttcatttctggggccacggaacccgggtcaccgtcttctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 152 - DNA, 609 bp, Homo sapiens
cgatttgccctgactcaacctgcctccgtgtctgggtctcctggacagacgatcaccataacctgcgctggaggcagcgtctcctggttccatttccctccaggcaaaacccccagactcattatttatgagtcttctaagagaccctcaggggtctctcctcgattctctgggtcccagtctggcagcacggcctccctaataatttctggcctccagtctgatgacgaagggacatacttctgttctattcttgaatttttcggcagagggactcttctcaccgtcctgagtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 153 - protein, 458 aa, Artificial Sequence
  antibody variant
AGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 154 - DNA, 1374 bp, Artificial Sequence
  antibody variant
gcgggactgatgcagtctggggctgtgatgaagaattcgggggcctcagtgagggtctcttgtcaggctgatggatacgacttcattgactatgtcattcactggtttcgacaaagacgtggagaaggtcttgagtggctgggatggatgaatccctcgggaggcggcacaaactatccgcgaccatttcagggcaaagtcaccatgaccagggacacgtccaccgagacagcctatttagatgtcagaggacttacatatgacgacacggccgtctattattgtgtgagagacagggccaacggttcgggaagaagacgttttgagtcggtgaattggttcctggatctgtggggccgcggcacccaaataacagtcgtctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 155 - protein, 205 aa, Artificial Sequence
  antibody variant
QSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 156 - DNA, 615 bp, Artificial Sequence
  antibody variant
cagtctgccctaactcagcctcgctcagtgtccgcatctcctggtcagtcagtcaccatctcctgcactggaacacacaattatgtgtcctggtgtcaacagaaaccgggccaagcccccaaattattaatttacgatttcaataaacggccctcaggggtctctgatcgcttctctggctccacgtctggcaacacggcctccctgaccatctctggactccaggctgacgatgagggtcattatttttgttgggcgtttgaaaatatcggcggagggaccaagctgaccgtcctgggtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 157 - protein, 458 aa, Artificial Sequence; identical to SEQ ID NO: 153
  antibody variant

SEQ ID NO: 158 - DNA, 1374 bp, Artificial Sequence; identical to SEQ ID NO: 154
  antibody variant

SEQ ID NO: 159 - protein, 205 aa, Artificial Sequence
  antibody variant
QSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 160 - DNA, 615 bp, Artificial Sequence
  antibody variant
cagtctgccctaactcagcctcgctcagtgtccgcatctcctggtcagtcagtcaccatctcctgcactggaacacacaattatgtgtcctggtgtcaacagaaaccgggccaagcccccaaattattaatttacgatttcaataaacggccctcaggggtctctgatcgcttctctggctccacgtctggcaacacggcctccctgaccatctctggactccaggctgacgatgagggtcattatttttgttgggcgtttgaaaatatcggcggagggaccaagctgaccgtcctgggtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 161 - protein, 457 aa, Artificial Sequence
  antibody variant
ADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 162 - DNA, 1371 bp, Artificial Sequence
  antibody variant
gcggacttggtgcagtctggggctgtggtgaagaagcctggggactcagtgaggatctcctgtgaggctcaaggatatagatttcctgactacatcattcactggattcgacgggcccctggacaaggccctgaatggatgggatggatgaatccaatgggcggacaagtaaatattccatggaaatttcagggtagggtctccatgacccgggacacgtccatcgaaacagcatttctggacttaagaggactaaagtctgacgacacggccgtctattattgcgtgagagatcgcagtaatggatcgggaaagcgattcgagtcctccaattggttcctcgatctgtggggccgtgggactgcggtcacaattcaatcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 163 - protein, 205 aa, Artificial Sequence
  antibody variant
QSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 164 - DNA, 615 bp, Artificial Sequence
  antibody variant
cagtctgccctgactcagcctcgctcagtgtccgcatctcctgggcagtccgtcaccatttcctgcactggaacccacaatttggtctcttggtgtcaacatcagccaggcagagcccccaaattattaatttatgacttcaataagaggccctcaggggtccctgatcgcttctctggctccgggtctggcggcacggcctccctgaccatcactggactccaggatgacgatgacgccgaatatttttgttgggcgtatgaagcttttggcggagggaccaagttgaccgttcttggtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 165 - protein, 457 aa, Artificial Sequence
  antibody variant
ADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 166 - DNA, 1371 bp, Artificial Sequence
  antibody variant
gcggacttggtgcagtctggggctgtggtgaagaagcctggggactcagtgaggatctcctgtgaggctcaaggatatagatttcctgactacatcattcactggattcgacgggcccctggacaaggccctgaatggatgggatggatgaatccaatgggcggacaagtaaatattccatggaaatttcagggtagggtctccatgacccgggacacgtccatcgaaacagcatttctggacttaagaggactaaagtctgacgacacggccgtctattattgcgtgagagatcgcagtaatggatcgggaaagcgattcgagtcctccaattggttcctcgatctgtggggccgtgggactgcggtcacaattcaatcatcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 167 - protein, 205 aa, Artificial Sequence; identical to SEQ ID NO: 4
  antibody variant

SEQ ID NO: 168 - DNA, 615 bp, Artificial Sequence; identical to SEQ ID NO: 80
  antibody variant

SEQ ID NO: 169 - protein, 457 aa, Artificial Sequence
  antibody variant
ADLQSGAVVKKPGDSVRISCEAQGYRFPDYIIHWIRRAVPGQGPEWMGWMNPMGGQVNIPWKFQGRVSMTRDTSIETAFLDLRGLKSDDTAVYYCVRDRSNGSGKRFESSNWFLDLWGRGTAVTIQSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 170 - DNA, 1371 bp, Artificial Sequence; identical to SEQ ID NO: 162
  antibody variant

SEQ ID NO: 171 - protein, 205 aa, Artificial Sequence
  antibody variant
QSALTQPRSVSASPGQSVTISCTGTHNLVSWAQHQPGRAPKLLIYDFNKRPSGVPDRFSGSGSGGTASLTITGLQDDDDAEYFCWAYEAFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 172 - DNA, 615 bp, Artificial Sequence
  antibody variant
cagtctgccctgactcagcctcgctcagtgtccgcatctcctgggcagtccgtcaccatttcctgcactggaacccacaatttggtctcttgggctcaacatcagccaggcagagcccccaaattattaatttatgacttcaataagaggccctcaggggtccctgatcgcttctctggctccgggtctggcggcacggcctccctgaccatcactggactccaggatgacgatgacgccgaatatttttgttgggcgtatgaagcttttggcggagggaccaagttgaccgttcttggtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 173 - protein, 457 aa, Artificial Sequence; identical to SEQ ID NO: 169
  antibody variant

SEQ ID NO: 174 - DNA, 1371 bp, Artificial Sequence; identical to SEQ ID NO: 162
  antibody variant

SEQ ID NO: 175 - protein, 205 aa, Artificial Sequence
  antibody variant
QSALTQPRSVSASPGQSVTISCTGTHNLVSWFQHQPGRAPKLLIYDFNKRPSGVPDRFSGSGSGGTASLTITGLQDDDDAEYFCWAYEAFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 176 - DNA, 615 bp, Artificial Sequence
  antibody variant
cagtctgccctgactcagcctcgctcagtgtccgcatctcctgggcagtccgtcaccatttcctgcactggaacccacaatttggtctcttggtttcaacatcagccaggcagagcccccaaattattaatttatgacttcaataagaggccctcaggggtccctgatcgcttctctggctccgggtctggcggcacggcctccctgaccatcactggactccaggatgacgatgacgccgaatatttttgttgggcgtatgaagcttttggcggagggaccaagttgaccgttcttggtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 177 - protein, 457 aa, Artificial Sequence; identical to SEQ ID NO: 169
  antibody variant

SEQ ID NO: 178 - DNA, 1371 bp, Artificial Sequence; identical to SEQ ID NO: 162
  antibody variant

SEQ ID NO: 179 - protein, 205 aa, Artificial Sequence
  antibody variant
QSALTQPRSVSASPGQSVTISCTGTHNLVSWSQHQPGRAPKLLIYDFNKRPSGVPDRFSGSGSGGTASLTITGLQDDDDAEYFCWAYEAFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 180 - DNA, 615 bp, Artificial Sequence
  antibody variant
cagtctgccctgactcagcctcgctcagtgtccgcatctcctgggcagtccgtcaccatttcctgcactggaacccacaatttggtctcttggtctcaacatcagccaggcagagcccccaaattattaatttatgacttcaataagaggccctcaggggtccctgatcgcttctctggctccgggtctggcggcacggcctccctgaccatcactggactccaggatgacgatgacgccgaatatttttgttgggcgtatgaagcttttggcggagggaccaagttgaccgttcttggtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 181 - protein, 457 aa, Artificial Sequence; identical to SEQ ID NO: 169
  antibody variant

SEQ ID NO: 182 - DNA, 1371 bp, Artificial Sequence; identical to SEQ ID NO: 162
  antibody variant

SEQ ID NO: 183 - protein, 205 aa, Artificial Sequence
  antibody variant
QSALTQPRSVSASPGQSVTISCTGTHNLVSWYQHQPGRAPKLLIYDFNKRPSGVPDRFSGSGSGGTASLTITGLQDDDDAEYFCWAYEAFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 184 - DNA, 615 bp, Artificial Sequence
  antibody variant
cagtctgccctgactcagcctcgctcagtgtccgcatctcctgggcagtccgtcaccatttcctgcactggaacccacaatttggtctcttggtatcaacatcagccaggcagagcccccaaattattaatttatgacttcaataagaggccctcaggggtccctgatcgcttctctggctccgggtctggcggcacggcctccctgaccatcactggactccaggatgacgatgacgccgaatatttttgttgggcgtatgaagcttttggcggagggaccaagttgaccgttcttggtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 185 - protein, 457 aa, Artificial Sequence
  antibody variant
ADLVQSGAVVKKPGDSVRISCEAQGYRFPDYIIHWIRRAPGQGPEWMGWMNPTYGQVNIPWKFQGRVSMTRDTSIETAFLDLRGLKSDDTAVYYCVRDRSNGSGKRFESSNWFLDLWGRGTAVTIQSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 186 - DNA, 1371 bp, Artificial Sequence
  antibody variant
gcggacttggtgcagtctggggctgtggtgaagaagcctggggactcagtgaggatctcctgtgaggctcaaggatatagatttcctgactacatcattcactggattcgacgggcccctggacaaggccctgaatggatgggatggatgaatccaacgtacggacaagtaaatattccatggaaatttcagggtagggtctccatgacccgggacacgtccatcgaaacagcatttctggacttaagaggactaaagtctgacgacacggccgtctattattgcgtgagagatcgcagtaatggatcgggaaagcgattcgagtcctccaattggttcctcgatctgtggggccgtgggactgcggtcacaattcaatcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 187 - protein, 205 aa, Artificial Sequence; identical to SEQ ID NO: 163
  antibody variant

SEQ ID NO: 188 - DNA, 615 bp, Artificial Sequence; identical to SEQ ID NO: 164
  antibody variant

SEQ ID NO: 189 - protein, 457 aa, Artificial Sequence
  antibody variant
ADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 190 - DNA, 1371 bp, Artificial Sequence
  antibody variant
gcggacttggtgcagtctggggctgtggtgaagaagcctggggactcagtgaggatctcctgtgaggctcaaggatatagatttcctgactacatcattcactggattcgacgggcccctggacaaggccctgaatggatgggatggatgaatccaatgggcggacaagtaaatattccatggaaatttcagggtagggtctccatgacccgggacacgtccatcgaaacagcatttctggacttaagaggactaaagtctgacgacacggccgtctattattgcgtgagagatcgcagtaatggatcgggaaagcgattcgagtcctccaattggttcctcgatctgtggggccgtgggactgcggtcacaattcaatcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctgcatgaggctctgcacagccactacacgcagaagagcctctccctgtccccgggtaaa

SEQ ID NO: 191 - protein, 205 aa, Artificial Sequence; identical to SEQ ID NO: 163
  antibody variant

SEQ ID NO: 192 - DNA, 615 bp, Artificial Sequence; identical to SEQ ID NO: 164
  antibody variant

SEQ ID NO: 193 - protein, 457 aa, Artificial Sequence
  antibody variant
ADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 194 - DNA, 1371 bp, Artificial Sequence
  antibody variant
gcggacttggtgcagtctggggctgtggtgaagaagcctggggactcagtgaggatctcctgtgaggctcaaggatatagatttcctgactacatcattcactggattcgacgggcccctggacaaggccctgaatggatgggatggatgaatccaatgggcggacaagtaaatattccatggaaatttcagggtagggtctccatgacccgggacacgtccatcgaaacagcatttctggacttaagaggactaaagtctgacgacacggccgtctattattgcgtgagagatcgcagtaatggatcgggaaagcgattcgagtcctccaattggttcctcgatctgtggggccgtgggactgcggtcacaattcaatcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctgcatgaggctctgcacagccactacacgcagaagagcctctccctgtccccgggtaaa

SEQ ID NO: 195 - protein, 205 aa, Artificial Sequence; identical to SEQ ID NO: 163
  antibody variant

SEQ ID NO: 196 - DNA, 615 bp, Artificial Sequence; identical to SEQ ID NO: 164
  antibody variant

SEQ ID NO: 197 - protein, 457 aa, Artificial Sequence
  antibody variant
ADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 198 - DNA, 1371 bp, Artificial Sequence
  antibody variant
gcggacttggtgcagtctggggctgtggtgaagaagcctggggactcagtgaggatctcctgtgaggctcaaggatatagatttcctgactacatcattcactggattcgacgggcccctggacaaggccctgaatggatgggatggatgaatccaatgggcggacaagtaaatattccatggaaatttcagggtagggtctccatgacccgggacacgtccatcgaaacagcatttctggacttaagaggactaaagtctgacgacacggccgtctattattgcgtgagagatcgcagtaatggatcgggaaagcgattcgagtcctccaattggttcctcgatctgtggggccgtgggactgcggtcacaattcaatcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctctatatcacccgggagcctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 199 - protein, 205 aa, Artificial Sequence; identical to SEQ ID NO: 163
  antibody variant

SEQ ID NO: 200 - DNA, 615 bp, Artificial Sequence; identical to SEQ ID NO: 164
  antibody variant

SEQ ID NO: 201 - protein, 457 aa, Artificial Sequence; identical to SEQ ID NO: 161
  antibody variant

SEQ ID NO: 202 - DNA, 1371 bp, Artificial Sequence; identical to SEQ ID NO: 162
  antibody variant

SEQ ID NO: 203 - protein, 205 aa, Artificial Sequence; identical to SEQ ID NO: 155
  antibody variant

SEQ ID NO: 204 - DNA, 615 bp, Artificial Sequence; identical to SEQ ID NO: 156
  antibody variant

SEQ ID NO: 205 - protein, 457 aa, Artificial Sequence; identical to SEQ ID NO: 161
  antibody variant

SEQ ID NO: 206 - DNA, 1371 bp, Artificial Sequence; identical to SEQ ID NO: 162
  antibody variant

SEQ ID NO: 207 - protein, 205 aa, Artificial Sequence; identical to SEQ ID NO: 8
  antibody variant

SEQ ID NO: 208 - DNA, 615 bp, Artificial Sequence; identical to SEQ ID NO: 84
  antibody variant

SEQ ID NO: 209 - protein, 457 aa, Artificial Sequence; identical to SEQ ID NO: 165
  antibody variant

SEQ ID NO: 210 - DNA, 1371 bp, Artificial Sequence; identical to SEQ ID NO: 166
  antibody variant

SEQ ID NO: 211 - protein, 206 aa, Artificial Sequence; identical to SEQ ID NO: 36
  antibody variant

SEQ ID NO: 212 - DNA, 618 bp, Artificial Sequence; identical to SEQ ID NO: 112
  antibody variant

SEQ ID NO: 213 - protein, 457 aa, Artificial Sequence; identical to SEQ ID NO: 165
  antibody variant

SEQ ID NO: 214 - DNA, 1371 bp, Artificial Sequence; identical to SEQ ID NO: 166
  antibody variant

SEQ ID NO: 215 - protein, 205 aa, Artificial Sequence; identical to SEQ ID NO: 14
  antibody variant

SEQ ID NO: 216 - DNA, 615 bp, Artificial Sequence; identical to SEQ ID NO: 90
  antibody variant

SEQ ID NO: 217 - protein, 460 aa, Artificial Sequence
  antibody variant
ADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSASTKGPSVFPLAPSSRSTSESTAALGCLVKDYFPEPVTVSWNSGSLTSGVHTFPAVLQSSGLYSLSSVVTVPSSSLGTQTYVCNVNHKPSNTKVDKRVEIKTCGGGSKPPTCPPCPAPELLGGPSVFLFPPKPKDTLMISRTPEVTCVVVDVSQEDPDVKFNWYVNGAEVHHAQTKPRETQYNSTYRVVSVLTVTHQDWLNGKEYTCKVSNKALPAPIQKTISKDKGQPREPQVYTLPPSREELTKNQVSLTCLVKGFYPSDIVVEWESSGQPENTYKTTPPVLDSDGSYFLYSKLTVDKSRWQQGNVFSCSVLHEALHSHYTQKSLSLSPGK

SEQ ID NO: 218 - DNA, 1380 bp, Artificial Sequence
  antibody variant
gcggacttggtgcagtctggggctgtggtgaagaagcctggggactcagtgaggatctcctgtgaggctcaaggatatagatttcctgactacatcattcactggattcgacgggcccctggacaaggccctgaatggatgggatggatgaatccaatgggcggacaagtaaatattccatggaaatttcagggtagggtctccatgacccgggacacgtccatcgaaacagcatttctggacttaagaggactaaagtctgacgacacggccgtctattattgcgtgagagatcgcagtaatggatcgggaaagcgattcgagtcctccaattggttcctcgatctgtggggccgtgggactgcggtcacaattcaatcagcctcgaccaagggcccatcggtcttccccctggcgccctcctccaggagcacctccgagagcacagcggccctgggctgcctggtcaaggactacttccctgaacccgtgaccgtgtcgtggaactcaggctccctgaccagcggcgtgcacaccttcccggctgtcctacagtcctcagggctctactccctcagcagcgtggtgaccgtgccctccagcagcttgggcacccagacctacgtctgcaacgtaaaccacaagcccagcaacaccaaggtggacaagagagttgagataaaaacatgtggtggtggcagcaaacctcccacgtgcccaccgtgcccagcacctgaactcctggggggaccgtcagtcttcctcttccccccaaaacccaaggacaccctcatgatctcccggacccctgaggtcacatgcgtggtggtagacgtgagccaggaagaccccgatgtcaagttcaactggtacgtaaatggcgcggaggtgcatcatgcccagacgaagccacgggagacgcagtacaacagcacatatcgtgtggtcagcgtcctcaccgtcacgcaccaggactggctgaacggcaaggagtacacgtgcaaggtctccaacaaagccctcccggcccccatccagaaaaccatctccaaagacaaagggcagccccgagagcctcaggtgtacaccctgcccccgtcccgggaggagctgaccaagaaccaggtcagcctgacctgcctggtcaaaggcttctaccccagtgacatcgtcgtggagtgggagagcagcgggcagccggagaacacctacaagaccaccccgcccgtgctggactccgacggctcctacttcctctacagcaagctcaccgtggacaagagcaggtggcagcaggggaacgtcttctcatgctccgtgctgcatgaggctctgcacagccactacacgcagaagagcctctccctgtccccgggtaaa

SEQ ID NO: 219 - protein, 205 aa, Artificial Sequence
  antibody variant
QSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGQPKAAPSVTLFPPSSEELQANKATLVCLISDFYPGAVEVAWKADGSAVNAGVETTKPSKQSNNKYAASSYLSLTSDQWKSHKSYSCQVTHEGSTVEKTVAPAECS

SEQ ID NO: 220 - DNA, 615 bp, Artificial Sequence
  antibody variant
cagtctgccctgactcagcctcgctcagtgtccgcatctcctgggcagtccgtcaccatttcctgcactggaacccacaatttggtctcttggtgtcaacatcagccaggcagagcccccaaattattaatttatgacttcaataagaggccctcaggggtccctgatcgcttctctggctccgggtctggcggcacggcctccctgaccatcactggactccaggatgacgatgacgccgaatatttttgttgggcgtatgaagcttttggcggagggaccaagttgaccgttcttggtcagcccaaggctgccccctcggtcactctgttcccgccctcgagcgaggagcttcaagccaacaaggccacactagtgtgtctgatcagtgacttctacccgggagccgtggaagtggcctggaaggcagatggcagcgctgtcaacgcgggagtggagaccaccaaaccctccaaacagagcaacaacaagtacgcggccagcagctacctgagcctgacgtccgaccagtggaagtcccacaagagctacagctgccaggtcacgcacgaagggagcaccgtggagaagacagtggcccctgcagaatgttca

SEQ ID NO: 221 - protein, 457 aa, Artificial Sequence
  antibody variant
ADLVQSGAVVKKPGDSVRISCEAQGYKFPDYIIHWIRRAPGQGLEWMGWINPMGGQVNIPWQFQGRVSMTRDTSIETAFLDLRGLKSDDTALYYCVRDRSNGSGRRFESSNWFLDLWGRGTAVTVHSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 222 - DNA, 1371 bp, Artificial Sequence
  antibody variant
gcggacttggtgcagtctggggctgtggtgaagaagcctggggactcagtgaggatctcctgtgaggctcaaggatacaaatttcctgactacatcattcactggattcgacgcgcccctggacaaggccttgagtggatggggtggattaatccaatgggcggacaagtaaacattccatggcagtttcagggcagggtctccatgacccgggacacgtccatcgaaacagcatttctggacttaagaggactaaagtctgacgacacggccctctattattgcgtgagagatcgaagtaatggatcgggaaggcgattcgagtcctccaattggttcctcgatctgtggggccgcggcactgcggtcactgttcattcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 223 - protein, 205 aa, Artificial Sequence; identical to SEQ ID NO: 6
  antibody variant

SEQ ID NO: 224 - DNA, 615 bp, Artificial Sequence; identical to SEQ ID NO: 82
  antibody variant

SEQ ID NO: 225 - protein, 458 aa, Artificial Sequence
  antibody variant
SAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 226 - DNA, 1374 bp, Artificial Sequence
  antibody variant
tcggcggaattggtgcaatctggggctgtggtgaagaagcctgggacctccgtgaaggtctcttgtcaggcttatggatacacttttaccgactaccttattcattggcttcgacaggcccctggacaaggacttgaatggatgggatggatgaatcctgtttatggacaagtaaattatgcccaaaactttcagggcagggtctccatgaccagggacatttacagggaaacagcatttctagaggtgcgcgacctgaagactgacgacacaggcacttattattgtgtgagagacacaggcgacggttcgcggagacactttgactccatcaattggtttctcgatctttggggccgcgggacatggataagggtcgccccagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 227 - protein, 205 aa, Artificial Sequence; identical to SEQ ID NO: 8
  antibody variant

SEQ ID NO: 228 - DNA, 615 bp, Artificial Sequence; identical to SEQ ID NO: 84
  antibody variant

SEQ ID NO: 229 - protein, 457 aa, Artificial Sequence
  antibody variant
ADLVQSGAVMKKPGDSVRISCEARGYTFTDYVIHWIRRAPGQGLEWMGWIDPPYGQVNIPWNFQGRVSMTRDTSIETAFLDLRGLKSDDTGLYYCVRDRSNGWGKRFESSNWFLDLWGRGTVVTVHSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 230 - DNA, 1371 bp, Artificial Sequence
  antibody variant
gcggacttggtgcagtctggggctgtgatgaagaagcctggggactcagtgagaatctcctgtgaggctcgaggatacacattcactgactacgtcattcactggattcgacgcgcccctggacaaggccttgaatggatggggtggattgatccaccttatggacaagtaaatattccatggaattttcagggcagggtctccatgacccgggacacgtccatcgaaacagcatttctggacttaagaggtctaaagtctgacgacacgggcctctattattgcgtgagagatcgaagtaatggatggggaaagcgattcgagtcctccaattggttcctcgatctgtggggccgcggcactgtggtcactgttcactcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 231 - protein, 205 aa, Artificial Sequence; identical to SEQ ID NO: 6
  antibody variant

SEQ ID NO: 232 - DNA, 615 bp, Artificial Sequence; identical to SEQ ID NO: 86
  antibody variant

SEQ ID NO: 233 - protein, 457 aa, Artificial Sequence; identical to SEQ ID NO: 229
  antibody variant

SEQ ID NO: 234 - DNA, 1371 bp, Artificial Sequence; identical to SEQ ID NO: 230
  antibody variant

SEQ ID NO: 235 - protein, 205 aa, Artificial Sequence
  antibody variant
QSALTQPRSVSASPGQSVTISCTGTHNLVSWCQHHPGRAPKLLIYDFNKRPSGVPDRFSGSGSGGTASLTISGLQDDDDAEYFCWAYEAFGGGTKLTVLRQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 236 - DNA, 615 bp, Artificial Sequence
  antibody variant
cagtctgccctgactcagcctcgctcagtgtccgcatctcctgggcagtccgtcaccatttcctgcactggaacccacaatttggtctcttggtgtcaacatcacccaggcagagcccccaagttattaatttatgacttcaataagaggccctcaggggtccctgatcgcttctctggctccgggtctggcggcacggcctccctaaccatcagtggactccaggatgacgatgacgccgaatatttttgttgggcatatgaagctttcggcggagggaccaagttgactgtacttcgtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 237 - protein, 457 aa, Artificial Sequence
  antibody variant
ADLVQSGAVVKKPGDSVRISCEAQGYTFTDYVIHWIRRAPGQGLEWMGWINPGYGQVNIPWNFQGRVSMTRDTSIETAFLDLRGLKSDDTGLYYCVRDRSNGWGKRFESSNWFLDLWGRGTVVTVHSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 238 - DNA, 1371 bp, Artificial Sequence
  antibody variant
gcggacttggtgcagtctggggctgtggtgaagaagcctggggactcagtgagaatctcctgtgaggctcaaggatacacattcactgactacgtcattcactggattcgacgcgcccctggacaaggccttgaatggatggggtggattaatccaggttatggacaagtaaatattccatggaactttcagggcagggtctccatgacccgagacacgtccatcgaaacagcatttctggacttaagaggtctaaagtctgacgacacgggcctctattattgcgtgagagatcgaagtaatggatggggaaagcgattcgagtcctccaattggttcctcgatctgtggggccgcggcactgtggtcactgttcactcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 239 - protein, 205 aa, Artificial Sequence; identical to SEQ ID NO: 12
  antibody variant

SEQ ID NO: 240 - DNA, 615 bp, Artificial Sequence; identical to SEQ ID NO: 88
  antibody variant

SEQ ID NO: 241 - protein, 457 aa, Artificial Sequence
  antibody variant
ADLVQSGAVVKNAGASVRVSCEAYGYTFVDYFIHWVRQAPGQGFEWMGYMDPLNGRPNIARKFQGRLSLSRDRSSETSFLDLSGLRSDDSAVYYCVRDKSNGSGRRFDSSNWFLDLWGRGTRVSIFSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 242 - DNA, 1371 bp, Artificial Sequence
  antibody variant
gcggacttggtgcagtctggggctgtggtgaaaaatgctggggcctcagtgagggtctcctgtgaggcttatggatacacattcgtggactacttcattcattgggtccgacaggcccctggacaaggctttgaatggatgggatacatggatcccttgaacgggcgcccaaacattgcgcgaaaatttcagggcaggctctccctgagtcgagataggtccagcgaaacttcatttctggacttaagtggactgaggtctgacgactcggccgtctattattgtgtgagagacaagagtaatggatcgggcagacggtttgactcgtctaattggtttctcgatctgtggggccgtggaacccgggtcagtattttctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 243 - protein, 205 aa, Artificial Sequence; identical to SEQ ID NO: 14
  antibody variant

SEQ ID NO: 244 - DNA, 615 bp, Artificial Sequence; identical to SEQ ID NO: 90
  antibody variant

SEQ ID NO: 245 - protein, 457 aa, Artificial Sequence
  antibody variant
ADLVQSGAVVKKPGDSVRVSCEAYGYTFSDYIIHWIRRAPGRGLEWMGWMNPMGGQVNIPWNFQGRVSMTRDTSIETAFLDLRGLRSDDTAVYYCVRDRSNGSGKRFESSNWFLDLWGRGTAVTISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 246 - DNA, 1371 bp, Artificial Sequence
  antibody variant
gcggacttggtgcagtctggggctgtggtgaagaagcctggggactcagtgagggtctcctgtgaggcttatggatacacattcagtgactacatcattcattggattcgacgggcccctggacgaggccttgaatggatgggatggatgaatccgatgggcggacaagtgaatattccgtggaactttcaggggagagtctccatgacccgggacacgtccatcgaaacagcatttctggacttaagaggactgaggtctgacgacacggccgtctattactgtgtgagagatcgcagcaatggatcgggcaagcgatttgagtcctccaattggttcctcgatctgtggggccgcgggaccgcggtcactatttcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 247 - protein, 205 aa, Artificial Sequence
  antibody variant
QSALTQPRSVSAAPGQSVTISCTGTHNLVSWCQHHPGRAPKLLIYDFNKRPSGVPDRFSGSGSGGTASLTITGLQDDDEAEYFCWAYEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 248 - DNA, 615 bp, Artificial Sequence
  antibody variant
cagtctgccctgactcagcctcgctcagtgtccgcagctcctggacagtccgtcaccatttcctgcactggaacccacaatttggtttcttggtgtcaacatcacccaggcagagcccccaagttattaatttatgacttcaataagagaccctcaggtgtccctgatcgtttctctggctccgggtctggcggcacggcctccctaaccatcactggactccaggatgacgatgaggctgaatatttttgttgggcgtatgaagtttttggcggagggaccaagttgaccgtgcttggtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 249 - protein, 457 aa, Artificial Sequence
  antibody variant
ADLVQSGAVVKTPGASVRVSCEAYGYTFIDYIIHWVRQAPGQGFEWLGYIDPMNGRPNIARKFQGRLSLSRDTSIETSFLDLSGLRSDDSAVYYCVRDKSNGSGKRFDSSNWFLDLWGRGTRVSISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 250 - DNA, 1371 bp, Artificial Sequence
  antibody variant
gcggacttggtgcagtctggggctgtggtgaagacgcctggggcctcagtgagggtctcctgtgaggcttatggatacacattcattgactacatcattcattgggtccgacaggcccctggacaaggttttgaatggctgggatacattgatcctatgaacgggcgcccaaacattgcgcgaaaatttcagggcaggctctccctgagccgggatacgtccatcgaaacatcatttctggacttaagtggactgaggtctgacgactcggccgtctattattgtgtgagagacaagagtaatggatcgggcaaacgatttgactcctctaattggtttctcgatctgtggggccgtggaacgcgggtcagcatttcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 251 - protein, 205 aa, Artificial Sequence
  antibody variant
QSALTQPRSVSAAPGQSVTISCTGTHNYVSWCQQHPGRAPKLLIYDFNKRPSGVPDRFSGSGSGGTASLTITRLQDDDDADYFCWAYDAFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 252 - DNA, 615 bp, Artificial Sequence
  antibody variant
cagtctgccctgactcagcctcgctcagtgtccgcagctcctggacagtcagtcaccatctcctgcactggaacccacaattatgtctcttggtgtcaacaacatccaggcagagcccccaaattactaatttatgacttcaataagaggccctcaggggtcccggatcgcttctctggctccggatctggcggcacggcctccctaaccatcactagactccaggatgacgatgacgctgactatttttgttgggcgtatgatgcttttggcggagggaccaagttgaccgtcctgggtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 253 - protein, 457 aa, Artificial Sequence; identical to SEQ ID NO: 249
  antibody variant

SEQ ID NO: 254 - DNA, 1371 bp, Artificial Sequence; identical to SEQ ID NO: 250
  antibody variant

SEQ ID NO: 255 - protein, 205 aa, Artificial Sequence; identical to SEQ ID NO: 18
  antibody variant

SEQ ID NO: 256 - DNA, 615 bp, Artificial Sequence; identical to SEQ ID NO: 94
  antibody variant

SEQ ID NO: 257 - protein, 457 aa, Artificial Sequence
  antibody variant
ADLVQSGAVVKKPGASVRVSCEAYGYTFTDYIIHWIRQAPGQGLEWMGWMNPMGGRTNIPWKFQGRVSMTRDTSIETAFLDLSGLTSDDTAVYYCVRDKSNGSGKRFDSSNWFLDLWGRGTPVTISSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 258 - DNA, 1371 bp, Artificial Sequence
  antibody variant
gcggacttggtgcagtctggggctgtggtgaagaagcctggggcctcagtgagggtctcctgtgaggcttatggatacacattcactgactacatcattcattggattcgacaggcccctggacaaggccttgaatggatgggatggatgaatcctatgggcgggcgcacaaatattccgtggaaatttcagggcagggtctccatgacccgggacacgtccatcgaaacagcatttctggacttaagtggactaacgtctgacgacacggccgtctattattgcgtgagagacaagagtaatggatcgggcaaacgatttgactcctctaattggttcctcgatctgtggggccgcggaaccccggtcactatttcctcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 259 - protein, 205 aa, Artificial Sequence; identical to SEQ ID NO: 20
  antibody variant

SEQ ID NO: 260 - DNA, 615 bp, Artificial Sequence; identical to SEQ ID NO: 96
  antibody variant

SEQ ID NO: 261 - protein, 457 aa, Artificial Sequence
  antibody variant
ADLVQSGAVVKKPGASVRVSCEAYGYTFVDYLIHWVRQAPGQGFEWMGYMDPMNGRPNIARKFQGRLSLSRDTSIETSFLDLSGLRSDDSAVYYCVRDKSGGSGKLFDSSNWFLDLWGRGTRVSISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 262 - DNA, 1371 bp, Artificial Sequence
  antibody variant
gcggacttggtgcagtctggggctgtggtgaagaagcctggggcctcagtgcgggtctcctgtgaggcttatggatatacattcgttgactacctcattcattgggtccgacaggcccccggacaaggttttgaatggatgggatacatggatcctatgaacgggcgcccaaatattgcgcgaaaatttcagggcaggctctccctgagccgagatacgtccatcgaaacatcatttctggacttaagtggactgaggtctgacgactcggccgtctattattgtgtgagagacaagagtggtggatcgggcaaactatttgactcctctaattggtttctcgatctgtggggccgtggaacccgggtcagcatttcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 263 - protein, 205 aa, Artificial Sequence; identical to SEQ ID NO: 22
  antibody variant

SEQ ID NO: 264 - DNA, 615 bp, Artificial Sequence; identical to SEQ ID NO: 98
  antibody variant

SEQ ID NO: 265 - protein, 457 aa, Artificial Sequence
  antibody variant
ADLVQSGAVVKKPGDSVRISCEAQGYTFTDYVIHWIRRAPGQGLEWMGWINPGYGQVNIPWNFQGRVSMTRDTSIETAFLELRGLKSDDTGLYYCVRDRSNGWGKRFESSNWFLDLWGRGTVITVHSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 266 - DNA, 1371 bp, Artificial Sequence
  antibody variant
gcggacttggtgcagtctggggctgtggtgaagaagcctggggactcagtgagaatctcctgtgaggctcaaggatacacattcactgactacgtcattcactggattcgacgggcccctggacaaggccttgaatggatggggtggattaatccaggttatggacaagtaaatattccatggaactttcagggcagggtctccatgacccgagacacgtccatcgaaacagcttttctggagttaagaggtctaaagtctgacgacacgggcctctattattgcgtgagagatcgaagtaatggatggggaaagcgattcgagtcctccaattggttcctcgatctgtggggccgcggcactgtgattactgttcactcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 267 - protein, 205 aa, Artificial Sequence; identical to SEQ ID NO: 24
  antibody variant

SEQ ID NO: 268 - DNA, 615 bp, Artificial Sequence; identical to SEQ ID NO: 100
  antibody variant

SEQ ID NO: 269 - protein, 457 aa, Artificial Sequence
  antibody variant
ADLVQSGAVVKKPGDSVRISCEAQGYTFTDYVIHWIRRAPGQGLEWMGWMDPSYGQVNIPRNFQGRVSMTRDTFRETAYLELRGLQSDDKGLYYCVRDRSHGSGRQFESSNWFLDLWGRGTVVNVQSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 270 - DNA, 1371 bp, Artificial Sequence
  antibody variant
gcggacttggtgcagtctggggctgtggtgaagaagcctggggactcagtgagaatctcctgtgaggctcagggatatacattcaccgactacgtcattcattggattcgacgggcccctggacaaggccttgaatggatggggtggatggatccaagttatggacaagtcaatattccacggaactttcagggcagggtctccatgacccgggacacgttcagggaaacagcatatctggaattaagaggtctacagtctgacgacaagggcctctattattgtgtgagagatcgaagtcacggatcgggaaggcaattcgagtcctccaactggttcctcgatctgtggggccgcggcactgtggtcaatgttcagtcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 271 - protein, 205 aa, Artificial Sequence; identical to SEQ ID NO: 26
  antibody variant

SEQ ID NO: 272 - DNA, 615 bp, Artificial Sequence; identical to SEQ ID NO: 102
  antibody variant

SEQ ID NO: 273 - protein, 457 aa, Artificial Sequence
  antibody variant
ADLVQSGAVVKKPGDSLRISCEAQGYTFTDYVIHWIRRAPGQGLEWMGWMDPSFGQMNIPRNFQGRVSMTRDMYIETAFLDLRGLKSDDTGLYYCVRDRSHGSGRLFESSNWFLDLWGRGTVVTVQSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 274 - DNA, 1371 bp, Artificial Sequence
  antibody variant
gcggacttggtgcagtctggggctgtggtgaagaagcctggggactcactgagaatctcctgtgaggctcaaggatacacattcactgactacgtcattcactggattcgacgggcccctggacaaggccttgaatggatgggatggatggatccaagttttggacaaatgaacattccacggaactttcagggcagggtctccatgacccgtgacatgtacatcgaaacagcatttctggacttaagaggtctaaagtctgacgacacgggcctctattattgcgtgagagatcgaagtcatggatcgggaaggctattcgagtcctccaattggttcctcgatctgtggggccgcggcactgtggtcactgttcagtcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 275 - protein, 205 aa, Artificial Sequence; identical to SEQ ID NO: 26
  antibody variant

SEQ ID NO: 276 - DNA, 615 bp, Artificial Sequence; identical to SEQ ID NO: 102
  antibody variant

SEQ ID NO: 277 - protein, 457 aa, Artificial Sequence
  antibody variant
ADLVQSGAVVKKPGDSVRISCEAQGYRFTDYVIHWIRRAPGQGLEWMGLMDPSFGRMNIPRKFQGRVSMTRDTSMETAFLDFRGLNFDDTGLYYCVRDRSHGSGRLFESSNWFLDLWGRGTVVTVQSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 278 - DNA, 1371 bp, Artificial Sequence
  antibody variant
gcggacttggtgcagtctggggctgtggtgaagaagcctggggactcagtgagaatctcctgtgaggctcaaggatacagattcactgactacgtcattcattggattcgacgggcccctggacaaggccttgaatggatggggttgatggatccaagttttggacgaatgaatattccacggaaatttcagggcagggtctccatgacccgggacacgtccatggaaacagcatttctggacttcagaggtctaaattttgacgacacgggcctctattattgcgtgagagatcgaagtcatggatcgggaagactattcgagtcctccaattggttcctcgatctgtggggccgcggcactgtggtcactgttcagtcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 279 - protein, 205 aa, Artificial Sequence; identical to SEQ ID NO: 26
  antibody variant

SEQ ID NO: 280 - DNA, 615 bp, Artificial Sequence; identical to SEQ ID NO: 106
  antibody variant

SEQ ID NO: 281 - protein, 457 aa, Artificial Sequence
  antibody variant
ADLVQSGAVVKKPGDSVRISCEAQGYTFIDYVIHWIRRAPGQGLEWMGLMDPTYGRMNIPRKFQGRVSMTRDTSIETAFLDLRGLKSDDTGLYYCVRDRSHGSGRLFESSNWFLDLWGRGTVVTVQSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 282 - DNA, 1371 bp, Artificial Sequence
  antibody variant
gcggacttggtgcagtctggggctgtggtgaagaagcctggggactcagtgagaatttcctgtgaggctcaaggatacacattcattgactacgtcattcactggattcgacgggcccctggacaaggccttgaatggatggggttgatggatccaacttatggacgaatgaatattccacggaagtttcagggcagggtctccatgacccgggacacgtccatcgaaacagcatttctggacttaagaggtctaaaatctgacgacacgggcctctattattgcgtgagagatcgaagtcatggatcgggaaggctattcgagtcctccaactggttcctggatctgtggggccgcggcactgtggtcactgttcagtcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 283 - protein, 205 aa, Artificial Sequence; identical to SEQ ID NO: 26
  antibody variant

SEQ ID NO: 284 - DNA, 615 bp, Artificial Sequence; identical to SEQ ID NO: 108
  antibody variant

SEQ ID NO: 285 - protein, 457 aa, Artificial Sequence
  antibody variant
ADLVQSGAVVKKPGDSVRISCEAQGYRFLDYIIHWIRRAPGQGLEWMGWMNPMGGQVNIPWNFQGRVSMTRDTSIETAFLDLRGLKSDDTAVYYCVRDRSNGSGKRFESSNWFLDLWGRGTAVTIHSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 286 - DNA, 1371 bp, Artificial Sequence
  antibody variant
gcggacttggtgcagtctggggctgtggtgaagaagcctggggactcagtgaggatctcctgtgaggctcaaggatacagatttcttgactacatcattcactggattcgacgagcccctggacaaggccttgaatggatgggatggatgaatccaatgggcggacaagtaaacattccatggaactttcagggtagggtctccatgacccgggacacgtccatcgaaacagcatttctggacttaagaggactaaagtctgacgacacggccgtctattattgcgtgagagatcgcagtaatggatcgggaaagcgattcgagtcctccaattggttcctcgatctgtggggccgcgggactgcggtcactattcattcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 287 - protein, 205 aa, Artificial Sequence; identical to SEQ ID NO: 34
  antibody variant

SEQ ID NO: 288 - DNA, 615 bp, Artificial Sequence; identical to SEQ ID NO: 110
  antibody variant

SEQ ID NO: 289 - protein, 457 aa, Artificial Sequence
  antibody variant
ADLVQSGAVVKKPGDSVRISCEAQGYRFLDYIIHWIRRAPGQGLEWMGWMNPMGGQVNIPWNFQGRVSMTRDTSIETAFLDLRGLKSDDTAVYYCVRDRSNGSGKRFESSNWFLDLWGRGTAVTIHSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 290 - DNA, 1371 bp, Artificial Sequence
  antibody variant
gcggacttggtgcagtctggggctgtggtgaagaagcctggggactcagtgaggatctcctgtgaggctcaaggatacagatttcttgactacatcattcactggattcgacgagcccctggacaaggccttgaatggatgggatggatgaatccaatgggcggacaagtaaacattccatggaactttcagggtagggtctccatgacccgggacacgtccatcgaaacagcatttctggacttaagaggactaaagtctgacgacacggccgtctattattgcgtgagagatcgcagtaatggatcgggaaagcgattcgagtcctccaattggttcctcgatctgtggggccgcgggactgcggtcactattcattcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 291 - protein, 205 aa, Artificial Sequence
  antibody variant
QSALTQPRSVSASPGQSVTISCTGTHNLVSWCQHHPGRAPKLLIYDFNKRPSGVPDRFSGSGSGGTASLTITGLQDDDDAEYFCWAYEAFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 292 - DNA, 615 bp, Artificial Sequence
  antibody variant
cagtctgccctgactcagcctcgctcagtgtccgcatctcctgggcagtccgtcaccatttcctgcactggaacccacaatttggtctcttggtgtcaacatcacccaggcagagcccccaaattattaatttatgacttcaataagaggccctcaggggtccctgatcgcttctctggctccgggtctggcggcacggcctccctgaccatcactggactccaggatgacgatgacgccgaatatttttgttgggcgtatgaagcttttggcggagggaccaagttgaccgtacttggtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 293 - protein, 450 aa, Artificial Sequence
  antibody variant
HVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 294 - DNA, 1350 bp, Artificial Sequence
  antibody variant
cacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 295 - protein, 206 aa, Artificial Sequence; identical to SEQ ID NO: 36
  antibody variant

SEQ ID NO: 296 - DNA, 618 bp, Artificial Sequence; identical to SEQ ID NO: 112
  antibody variant

SEQ ID NO: 297 - protein, 450 aa, Artificial Sequence; identical to SEQ ID NO: 293
  antibody variant

SEQ ID NO: 298 - DNA, 1350 bp, Artificial Sequence; identical to SEQ ID NO: 294
  antibody variant

SEQ ID NO: 299 - protein, 206 aa, Artificial Sequence
  antibody variant
ASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 300 - DNA, 618 bp, Artificial Sequence
  antibody variant
gcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 301 - protein, 450 aa, Artificial Sequence
  antibody variant
HVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 302 - DNA, 1350 bp, Artificial Sequence
  antibody variant
cacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcatcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 303 - protein, 206 aa, Artificial Sequence
  antibody variant
ASALTQPASMSASPGQSVTISCSGTRHIISAWFQQYPGKPPKLIIFDDDKRPSGVPSRFSASRPGDTASLTISNVQPEDEATYICNTYEFFGGGTRLTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 304 - DNA, 618 bp, Artificial Sequence
  antibody variant
gcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaggtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 305 - protein, 453 aa, Artificial Sequence
  antibody variant
HVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCVRDRSNGSGKRFESSNWGQGVRVVVSSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 306 - DNA, 1359 bp, Artificial Sequence
  antibody variant
cacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgtgagagatcgcagtaatggatcgggaaagcgattcgagtcctccaattggggccagggtgtccgagtggtcgtctcgtcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 307 - protein, 206 aa, Artificial Sequence; identical to SEQ ID NO: 36
  antibody variant

SEQ ID NO: 308 - DNA, 618 bp, Artificial Sequence; identical to SEQ ID NO: 112
  antibody variant

SEQ ID NO: 309 - protein, 458 aa, Artificial Sequence
  antibody variant
HVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCVRDRSNGSGKRFESSNWFLDLWGQGVRVVVSSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 310 - DNA, 1374 bp, Artificial Sequence
  antibody variant
cacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgtgagagatcgcagtaatggatcgggaaagcgattcgagtcctccaattggttcctcgatctgtggggccagggtgtccgagtggtcgtctcgtcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 311 - protein, 206 aa, Artificial Sequence; identical to SEQ ID NO: 36
  antibody variant

SEQ ID NO: 312 - DNA, 618 bp, Artificial Sequence; identical to SEQ ID NO: 112
  antibody variant

SEQ ID NO: 313 - protein, 458 aa, Artificial Sequence
  antibody variant
HVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCVRDRSNGSGKRFESSNWFLDLWGRGTAVTIQSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 314 - DNA, 1374 bp, Artificial Sequence
  antibody variant
cacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgtgagagatcgcagtaatggatcgggaaagcgattcgagtcctccaattggttcctcgatctgtggggccgtgggactgcggtcacaattcaatcatcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 315 - protein, 206 aa, Artificial Sequence
  antibody variant
ASALTQPASMSASPGQSVTISCSGTRHIISAWFQQYPGKPPKLIIFDDDKRPSGVPSRFSASRPGDTASLTISNVQPEDEATYICNTYEFFGGGTRLTVLRQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 316 - DNA, 618 bp, Artificial Sequence
  antibody variant
gcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctacgtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 317 - protein, 450 aa, Artificial Sequence
  antibody variant
HIQLLQSGPQVKKSGDTVRISCETSGYNFVDSRIHWVRQTPEKRLRWMGWINPLQGGVNYAPEFQGRIRMTRDTFIDTVYVDLSGLTPADTAYYYCARGIDGKSYPFHFWGHGTRVTVFSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 318 - DNA, 1350 bp, Artificial Sequence
  antibody variant
cacattcagttgctacagtcggggcctcaagttaagaagtctggggacacagtgagaatctcctgtgagacctctggatataacttcgtcgactcccgtatccactgggtccgacagaccccggaaaaacgtctcagatggatgggctggatcaatcctctccaaggtggtgtgaattacgcgccggaatttcagggcagaatcaggatgaccagggacacatttatagacacagtttacgtggacctgagcggactgacaccggccgacacggcctattattactgcgcgcgagggatcgatggcaagtcttacccctttcatttctggggccacggaacccgggtcaccgtcttctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 319 - protein, 203 aa, Artificial Sequence; identical to SEQ ID NO: 38
  antibody variant

SEQ ID NO: 320 - DNA, 609 bp, Artificial Sequence; identical to SEQ ID NO: 114
  antibody variant

SEQ ID NO: 321 - protein, 453 aa, Artificial Sequence
  antibody variant
QVRLVQSGAGARKTGASMKLSCSTSGYTFTTHHGHFINWVRQARGQGLEWMGWMNPMTGQMNIEGKFQGRVTLTRDIYSDTAYMEMTRLTTGDTGTYYCARGDFGQNYPFHYWGQGSLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 322 - DNA, 1359 bp, Artificial Sequence
  antibody variant
caggtgcgcttggtgcagtctggggctggggcgaggaagactggggcctcaatgaaactttcctgctcgacctctggatacaccttcaccactcatcacggccacttcataaattgggtgcgacaggcccgtggacaagggcttgagtggatggggtggatgaatcccatgactgggcagatgaatattgaggggaaatttcagggcagagtcaccctcactcgagacatatacagtgacacggcttacatggaaatgaccagactgacaactggcgacacgggcacttattactgtgcgcgaggcgatttcggacagaattatccctttcattattggggccagggaagcctggtcatcgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 323 - protein, 206 aa, Artificial Sequence; identical to SEQ ID NO: 40
  antibody variant

SEQ ID NO: 324 - DNA, 618 bp, Artificial Sequence; identical to SEQ ID NO: 116
  antibody variant

SEQ ID NO: 325 - protein, 450 aa, Artificial Sequence
  antibody variant
HVQLVQSGGGVKKIGAAVRISCEVSGYNFMDQFINWVRQAPGQGLEWMGWMNPIYGQVNYSWRFQGRVTMTRDMYTDTAFMELRGLRVDDTAVYYCARGPSGENYPFHYWGQGVRVVVSSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 326 - DNA, 1350 bp, Artificial Sequence
  antibody variant
cacgtccaattggtgcagtctggaggtggggtgaagaagattggggccgctgtgaggatctcctgcgaggtgtctggatacaacttcatggaccaattcataaattgggtgcgacaggcccccggtcagggccttgagtggatgggatggatgaacccaatatatggacaagtaaattattcatggagatttcaaggaagggtcaccatgaccagggacatgtacaccgacacggccttcatggagttgagaggactgagagtggacgacacggccgtctattattgcgcgaggggaccctctggggaaaattatccttttcactattggggccagggtgtccgagtggtcgtctcgtcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 327 - protein, 206 aa, Artificial Sequence
  antibody variant
ASALTQPASMSASPGQSVTISCSGTRHIISAWFQQYPGKPPKLIIFDDDKRPSGVPSRFSASRPGDTASLTISNVQPEDEATYICNTYEFFGGGTKLTVLRQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 328 - DNA, 618 bp, Artificial Sequence
  antibody variant
gcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacatacatttgcaatacatatgaattctttggcggagggaccaaattgaccgtcctacgtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 329 - protein, 450 aa, Artificial Sequence; identical to SEQ ID NO: 325
  antibody variant

SEQ ID NO: 330 - DNA, 1350 bp, Artificial Sequence; identical to SEQ ID NO: 326
  antibody variant

SEQ ID NO: 331 - protein, 206 aa, Artificial Sequence; identical to SEQ ID NO: 42
  antibody variant

SEQ ID NO: 332 - DNA, 618 bp, Artificial Sequence; identical to SEQ ID NO: 118
  antibody variant

SEQ ID NO: 333 - protein, 450 aa, Artificial Sequence
  antibody variant
HIQLLQSGPQVKKSGDTVRISCETSGYNFVDSRIHWVRQTPEKRLRWMGWINPLHGGVNYAPEFQGRIRMTRDTFIDTVYVDLSGLTPADTAYYYCARGIDGKSYPFHFWGHGTRVTVFSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 334 - DNA, 1350 bp, Artificial Sequence
  antibody variant
cacattcagttgctacagtcggggcctcaagttaagaagtctggggacacagtgagaatctcctgtgagacctctggatataacttcgtcgactcccgtatccactgggtccgacagaccccggaaaaacgtctcagatggatgggctggatcaatcctctccacggtggtgtgaattacgcgccggaatttcagggcagaatcaggatgaccagggacacatttatagacacagtttacgtggacctgagcggactgacaccggccgacacggcctattattactgcgcgcgagggatcgatggcaagtcttacccctttcatttctggggccacggaacccgggtcaccgtcttctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 335 - protein, 203 aa, Artificial Sequence; identical to SEQ ID NO: 38
  antibody variant

SEQ ID NO: 336 - DNA, 609 bp, Artificial Sequence; identical to SEQ ID NO: 120
  antibody variant

SEQ ID NO: 337 - protein, 455 aa, Artificial Sequence
  antibody variant
RVTLQQSGAIVRQPGASVTVSCETSGYTFTKYFIYWVRQAPGQGLEWLGRIHPRTGAVKYAPRFQGRLSMTRDWSLDTAYLGLTGLTLGDTALYFCARGAFEADSYGSSYPFHHWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 338 - DNA, 1365 bp, Artificial Sequence
  antibody variant
cgtgttacattacaacaatctggggctatagtgaggcagcctggggcctcagtgaccgtctcctgcgagacttctggatatactttcaccaagtatttcatctactgggtgcgacaggcccctggacagggtcttgagtggctgggcagaatacacccccgaaccggtgccgtgaagtatgcaccgagatttcagggtagactgtccatgaccagagactggtcactcgacacagcctacctcggattgaccggactgacactcggcgacacggctctatatttctgtgcgaggggggcctttgaggcagattcatatgggtcaagttatccctttcaccactggggccagggaaccctagtcaccgtctccgcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 339 - protein, 207 aa, Artificial Sequence; identical to SEQ ID NO: 46
  antibody variant

SEQ ID NO: 340 - DNA, 621 bp, Artificial Sequence; identical to SEQ ID NO: 122
  antibody variant

SEQ ID NO: 341 - protein, 455 aa, Artificial Sequence
  antibody variant
RVTLQQSGATVKQPGASVTVSCETSGYTFTKYTIHWVRQAPGQGLQWVGRIHPRTGAVKYAPIFQGKVSMSRDLSRDTAYLGLTRLTLADTALFFCARGAFEADLSGPTYPFHHWGQGTLVIVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 342 - DNA, 1365 bp, Artificial Sequence
  antibody variant
cgtgtgacattacaacaatctggggctacagtgaagcagcctggggcctcagtgaccgtctcctgcgagacttctggatacactttcaccaagtataccattcactgggtgcgacaggcccctggacagggtcttcagtgggtgggcagaatacacccccgaaccggtgccgtgaagtatgcaccgatatttcagggtaaagtgtccatgagtcgagacttgtcacgcgacacagcctacctcggattgaccagactgacgctcgccgacacggctctatttttctgtgcgaggggggcctttgaggcagatttaagtgggccaacttacccctttcaccactggggccaaggaaccctagtcatcgtctccgcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 343 - protein, 207 aa, Artificial Sequence; identical to SEQ ID NO: 48
  antibody variant

SEQ ID NO: 344 - DNA, 621 bp, Artificial Sequence; identical to SEQ ID NO: 124
  antibody variant

SEQ ID NO: 345 - protein, 450 aa, Artificial Sequence
  antibody variant
NVQLMQSGTEVKKSGASVTISCETAGFNFIDSVIHWLRQAPGGGFQWMGWIKPLRGAVNYPQFLQGRVSMTRDLSTDTVYMVLNGLTPDDTGLYYCAKGAFRGGSPFGFWGQGTLLTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 346 - DNA, 1350 bp, Artificial Sequence
  antibody variant
aacgtgcagttgatgcagtctgggactgaggtgaagaagtctggggcctcggtgacaatctcttgtgagaccgctggattcaacttcatcgactccgtcatacactggctgcgccaggcccctggaggaggatttcagtggatggggtggatcaagcctcttagaggtgccgtcaattatccacagtttttgcagggcagggtctccatgacccgggacttgtccaccgacacggtgtacatggtcttgaatggactgacacctgacgacacaggcctttattactgcgcgaaaggggcctttagagggggttctccctttggcttctggggccagggaactctgctcaccgtctccccagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 347 - protein, 202 aa, Artificial Sequence; identical to SEQ ID NO: 50
  antibody variant

SEQ ID NO: 348 - DNA, 606 bp, Artificial Sequence; identical to SEQ ID NO: 126
  antibody variant

SEQ ID NO: 349 - protein, 450 aa, Artificial Sequence
  antibody variant
QVRLVQSGPQVKKTGASVRVSCETSGYTFTSYFIHWLRLGPGEGLQWMGWINPLHGAVNYENKFRGRVTITRDTSTDTVYLDMSRLTPDDTAVYFCTRGIVADGWPYGHWGQGTQVTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 350 - DNA, 1350 bp, Artificial Sequence
  antibody variant
caggtgcgactggtgcagtctgggcctcaggtgaagaagactggggcctcagtgagggtctcctgcgaaacctctggatacacgttcacctcctacttcatccattggttacgactgggccccggagaggggcttcagtggatggggtggatcaaccctttacatggtgccgtgaattatgaaaacaaatttaggggcagggtcacaatcaccagggacacgtccacagacacagtgtatttggacatgagcagactgacccctgacgacacggccgtctatttctgcacaagaggaatcgttgctgatgggtggccctatggccactggggccagggaacccaagtcaccgtctccccggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 351 - protein, 203 aa, Artificial Sequence; identical to SEQ ID NO: 52
  antibody variant

SEQ ID NO: 352 - DNA, 609 bp, Artificial Sequence; identical to SEQ ID NO: 128
  antibody variant

SEQ ID NO: 353 - protein, 451 aa, Artificial Sequence
  antibody variant
QVRLQQSGVVVRKPGASVRISCETSGFTFIDHIVHWVRRAPGRGFEWMGWIKPLRGAVDYAPQLRGRISLTRDIYSETVFIDVSRLTSGDTAIYFCCKAAAPEEAFPLQYWGQGTQLIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 354 - DNA, 1353 bp, Artificial Sequence
  antibody variant
caggtgcgacttcagcagtctggtgtcgtggtgaggaagcctggggcctcagtgagaatttcctgcgagacttctggattcaccttcatcgaccacattgtccattgggtgcggcgggcccctggacgaggctttgaatggatgggttggatcaagcctcttaggggtgccgtagattatgcaccccaacttcggggcaggatctccctgacgagggacatttacagtgaaaccgtctttatagacgtgagccgactgacgtctggcgacacggcgatatacttttgttgtaaggccgccgcccctgaagaagcattcccccttcaatactggggccaggggacccaacttatcgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 355 - protein, 205 aa, Artificial Sequence; identical to SEQ ID NO: 54
  antibody variant

SEQ ID NO: 356 - DNA, 615 bp, Artificial Sequence; identical to SEQ ID NO: 130
  antibody variant

SEQ ID NO: 357 - protein, 451 aa, Artificial Sequence
  antibody variant
QVRLQQSGVVVRKPGASVRLSCETSGFKFIDHIVNWVRRAPGRGFEWMGWIKPLGGVADYAPQHRGRISLTRDIYTETVFIDLSRLTSGDTAIYFCCKAAAPDEAFPLEYWGQGTQLIVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 358 - DNA, 1353 bp, Artificial Sequence
  antibody variant
caggtgcgacttcagcagtctggtgtcgtggtgaggaagcctggggcctcagtgagactttcctgcgagacgtctggattcaaattcatcgaccacattgtcaactgggtgcggcgggcccctggacgaggctttgaatggatgggttggatcaagcctcttgggggtgtcgctgattatgcaccccaacatcggggcaggatctcactgacgagggacatttacactgaaaccgtctttatagacctgagtcgactgacgtctggcgacacggcgatttatttctgttgtaaggccgccgcccctgatgaagcattcccccttgaatactggggccaggggacccaacttatcgtctccccggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 359 - protein, 205 aa, Artificial Sequence; identical to SEQ ID NO: 56
  antibody variant

SEQ ID NO: 360 - DNA, 615 bp, Artificial Sequence; identical to SEQ ID NO: 132
  antibody variant

SEQ ID NO: 361 - protein, 451 aa, Artificial Sequence
  antibody variant
QVRLVQSGPVMRKPGASVRISCETSGFAFLDHIVHWVRRAPGRGFEWMGWVKTIGGVVDYAPHLRGRISVTRDVFSETVFLDLSRLTSGDTAMYFCSKAAAPDEAFPLEFWGQGTQVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 362 - DNA, 1353 bp, Artificial Sequence
  antibody variant
caggtgcgacttgtgcagtctggtcccgtgatgagaaagcctggggcctcagtgagaatttcttgcgagacatctggattcgccttcttggaccacattgtccactgggtgcggcgggcccctggacgcggctttgaatggatgggttgggttaagaccattgggggtgtcgttgattatgcaccccaccttaggggcaggatctccgtgacgagagacgtctttagtgaaaccgtctttctggacttgagccgactgacgtctggcgacacggcgatgtatttttgttctaaggccgccgcccctgacgaagccttcccccttgaattttggggccaggggacccaagtcatcgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 363 - protein, 205 aa, Artificial Sequence; identical to SEQ ID NO: 58
  antibody variant

SEQ ID NO: 364 - DNA, 615 bp, Artificial Sequence; identical to SEQ ID NO: 134
  antibody variant

SEQ ID NO: 365 - protein, 451 aa, Artificial Sequence
  antibody variant
QVRLVQSGPVVRKPGTSVRISCETSGFAFLDHIVHWVRRAPGRGFEWMGWVKTIGGVVDYAPHLRGRISVTRDVFSEIVFMELSRLTSGDTAMYFCSKAAAPDEAFPLEFWGQGTQVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 366 - DNA, 1353 bp, Artificial Sequence
  antibody variant
caggtgcgacttgtgcagtctggtcccgtggtgagaaagcctgggacctcagtgagaatttcttgcgagacatctggattcgccttcttggaccacattgtccactgggtgcggcgggcccctggacgcggctttgaatggatgggttgggttaagaccattgggggtgtcgttgattatgcaccccaccttaggggcaggatctccgtgacgagggacgtatttagtgaaatcgtctttatggagttgagtcgactgacgtctggcgacacggcgatgtatttttgttctaaggccgccgcccctgacgaagccttcccccttgaattttggggccaggggacccaagtcatcgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 367 - protein, 205 aa, Artificial Sequence; identical to SEQ ID NO: 60
  antibody variant

SEQ ID NO: 368 - DNA, 615 bp, Artificial Sequence; identical to SEQ ID NO: 136
  antibody variant

SEQ ID NO: 369 - protein, 450 aa, Artificial Sequence
  antibody variant
QVQLVQSGAGVKKPGASVRVSCETSGFKFTEYFIHFLRQAPGQGLEWMGWLNPLRGAVNYPRKFQGRVTLTRDIYTTTVYMQLNGLTPDDTAVYYCARAVFNEAFPFDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 370 - DNA, 1350 bp, Artificial Sequence
  antibody variant
caagtgcaactggtgcagtctggggctggggtgaagaagcctggggcctcagtgagggtctcctgcgagacatccggattcaagttcaccgagtactttatccactttttacgacaggcccctggacaagggcttgagtggatgggatggctcaaccctctcagaggtgccgtcaactatccacggaagtttcagggcagagtcactttgaccagggacatctacaccaccaccgtctacatgcaacttaacggtctgacccctgacgacacggccgtctactactgtgccagagcggtctttaatgaagctttcccctttgactactggggccagggaagcctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 371 - protein, 204 aa, Artificial Sequence; identical to SEQ ID NO: 62
  antibody variant

SEQ ID NO: 372 - DNA, 612 bp, Artificial Sequence; identical to SEQ ID NO: 138
  antibody variant

SEQ ID NO: 373 - protein, 451 aa, Artificial Sequence; identical to SEQ ID NO: 357
  antibody variant

SEQ ID NO: 374 - DNA, 1353 bp, Artificial Sequence
  antibody variant
caggtgcgacttcagcagtctggtgtcgtggtgaggaagcctggggcctcagtgagactttcctgcgagacgtctggcttcaaattcatcgaccacattgtcaactgggtgcggcgggcccctggacgaggctttgaatggatgggttggatcaagcctcttgggggtgtcgctgattatgcaccccaacatcggggcaggatctcactgacgagggacatttacactgaaaccgtctttatagacctgagtcgactgacgtctggcgacacggcgatttatttttgttgtaaggccgccgcccctgatgaagcattcccccttgaatactggggccaggggacccaacttatcgtctccccggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 375 - protein, 205 aa, Artificial Sequence; identical to SEQ ID NO: 64
  antibody variant

SEQ ID NO: 376 - DNA, 615 bp, Artificial Sequence; identical to SEQ ID NO: 140
  antibody variant

SEQ ID NO: 377 - protein, 451 aa, Artificial Sequence; identical to SEQ ID NO: 361
  antibody variant

SEQ ID NO: 378 - DNA, 1353 bp, Artificial Sequence
  antibody variant
caggtgcgacttgtgcagtctggtcccgtgatgagaaagcctggggcctcagtgagaatttcttgcgagacatctggattcgccttcttggaccacattgtccactgggtgcggcgggcccctggacgcggctttgaatggatgggttgggttaagaccattgggggtgtcgttgattatgcaccccaccttaggggcaggatctccgtgacgagagacgtctttagtgaaaccgtctttctggacttgagtcgactgacgtctggcgacacggcgatgtatttttgttctaaggccgccgcccctgacgaagccttcccccttgaattttggggccaggggacccaagtcatcgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 379 - protein, 205 aa, Artificial Sequence; identical to SEQ ID NO: 58
  antibody variant

SEQ ID NO: 380 - DNA, 615 bp, Artificial Sequence; identical to SEQ ID NO: 142
  antibody variant

SEQ ID NO: 381 - protein, 450 aa, Artificial Sequence
  antibody variant
HVQLRQSGTEAKKSGASVTISCETAGFNFIDSVIHWLRQAPGGGFQWMGWIKPLRGGVNYPHYLQGRISMTRDLSSDTVYMVLNRLTPADTGLYYCAKGAFGGSSPFGFWGQGTLLTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 382 - DNA, 1350 bp, Artificial Sequence
  antibody variant
cacgtgcagttgaggcagtctgggactgaggcgaagaagtctggggcctcggtgacaatctcttgtgagaccgctggattcaacttcatcgactccgtcatacactggctgcgccaggcccctggtgggggatttcagtggatggggtggatcaagcctcttagaggtggcgtcaattatccacattatttgcagggcagaatctccatgacccgggacttgtccagtgacacggtttacatggtcttaaatagactgacacctgccgacacaggcctttattactgcgcgaaaggggcctttggggggagttctccctttggcttctggggccagggaactctgctcaccgtctccccagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 383 - protein, 202 aa, Artificial Sequence; identical to SEQ ID NO: 68
  antibody variant

SEQ ID NO: 384 - DNA, 606 bp, Artificial Sequence; identical to SEQ ID NO: 144
  antibody variant

SEQ ID NO: 385 - protein, 450 aa, Artificial Sequence
  antibody variant
HVQLMQSGTQAKKSGASVTISCETAGFKFIDSVIHWLRQAPGGGFQWMGWIKPLGGAVNYPPYLQGRISLTRDLSTDTIYMVLNGLTPADTGFYYCAKGAFGGGSPFGFWGQGTLLTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 386 - DNA, 1350 bp, Artificial Sequence
  antibody variant
cacgtgcaattgatgcagtctgggactcaggcgaagaagtctggggcctcggtgacaatttcttgtgagaccgctggattcaagttcatcgactccgtcatacactggctgcgccaggcccctggagggggatttcagtggatggggtggatcaagcctcttggaggtgccgtcaactatccaccctatttgcagggcaggatctccttgacccgtgacttgtccaccgacacaatttacatggtcttgaatggactgacacctgccgacacaggcttttattactgcgccaaaggggcctttggggggggttctccctttggcttctggggccaggggactctgctcaccgtctccccagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 387 - protein, 202 aa, Artificial Sequence; identical to SEQ ID NO: 70
  antibody variant

SEQ ID NO: 388 - DNA, 606 bp, Artificial Sequence; identical to SEQ ID NO: 146
  antibody variant

SEQ ID NO: 389 - protein, 450 aa, Artificial Sequence
  antibody variant
HVQLRQSGTEAKKSGASVTISCETAGFNFIDSVIHWLRQAPGGGFQWMGWIKPLRGGVNYPHYLQGRISMTRDLSSDTVYMVLNRLTPDDTGLYYCAKGAFGGSSPFGFWGQGTLLTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 390 - DNA, 1350 bp, Artificial Sequence
  antibody variant
cacgtgcagttgaggcagtctgggactgaggcgaagaagtctggggcctcggtgacaatctcttgtgagaccgctggattcaacttcatcgactccgtcatacactggctgcgccaggcccctggtgggggatttcagtggatggggtggatcaagcctcttagaggtggcgtcaattatccacattatttgcagggcagaatctccatgacccgggacttgtccagtgacacggtttacatggtcttaaatagactgacacctgacgacacaggcctttactactgcgcgaaaggggcctttggggggagttctccctttggcttctggggccagggaactctgctcaccgtctccccagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 391 - protein, 202 aa, Artificial Sequence; identical to SEQ ID NO: 72
  antibody variant

SEQ ID NO: 392 - DNA, 606 bp, Artificial Sequence; identical to SEQ ID NO: 148
  antibody variant

SEQ ID NO: 393 - protein, 455 aa, Artificial Sequence
  antibody variant
RVTLQQSGATVRQPGASVTVSCETSGFTFIKYTIHWVRQAPGQGLQWVGRIHPRTGAVKFAPIFQGKFSMSRDLSRDTAYLGLTRLTLADTALFFCARGAFEADLYGPTYPFHHWGQGTQVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 394 - DNA, 1365 bp, Artificial Sequence
  antibody variant
cgtgttacattacaacagtctggggctacagtgaggcagcctggggcctcagtcaccgtctcctgcgagacttctggattcaccttcatcaaatataccattcactgggtgcgacaggcccctggacagggtcttcagtgggtgggaagaatacacccccgaaccggtgccgtgaagtttgcaccgatatttcagggtaaattttccatgagtcgagacttgtcacgcgacacagcctacctcggattgaccagactgacactcgccgacacggctctatttttctgtgcgaggggggcctttgaggcagatttatatgggccaacttacccctttcaccactggggccaaggaacccaagtcaccgtctccgcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 395 - protein, 207 aa, Artificial Sequence; identical to SEQ ID NO: 74
  antibody variant

SEQ ID NO: 396 - DNA, 621 bp, Artificial Sequence; identical to SEQ ID NO: 150
  antibody variant

SEQ ID NO: 397 - protein, 450 aa, Artificial Sequence
  antibody variant
HIQLLQSGPQVKKSGDTVRISCETSGYNFVDSLIHWVRQTPEKRLRWMGWINPLQGGVNYAPEFQGRIRMTRDTFIDTVYVDLSGLTPADTAYYYCARGIDGNSYPFHFWGHGTRVTVFSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 398 - DNA, 1350 bp, Artificial Sequence
  antibody variant
cacattcagttgctacagtcggggcctcaagttaagaagtctggggacacagtgagaatctcctgtgagacctctggatataatttcgtcgactcccttatccactgggtccgacagaccccggaaaaacgtctcagatggatgggctggatcaatcctctccaaggtggtgtgaattacgcgccggaatttcagggcagaatcaggatgaccagggacacgtttatagacacagtttacgtggacttgagcggactgacaccggccgacacggcctattattactgcgcgcgagggatcgatggcaattcttacccctttcatttctggggccacggaacccgggtcaccgtcttctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 399 - protein, 203 aa, Artificial Sequence; identical to SEQ ID NO: 76
  antibody variant

SEQ ID NO: 400 - DNA, 609 bp, Artificial Sequence; identical to SEQ ID NO: 152
  antibody variant

SEQ ID NO: 401 - protein, 8 aa, Artificial Sequence
  CDR
GYDFIDYV

SEQ ID NO: 402 - protein, 8 aa, Artificial Sequence
  CDR
MNPSGGGT

SEQ ID NO: 403 - protein, 22 aa, Artificial Sequence
  CDR
VRDRANGSGRRRFESVNWFLDL

SEQ ID NO: 404 - protein, 5 aa, Artificial Sequence
  CDR
WAFEN

SEQ ID NO: 405 - protein, 8 aa, Artificial Sequence
  CDR
GYKFPDYI

SEQ ID NO: 406 - protein, 8 aa, Artificial Sequence
  CDR
INPMGGQV

SEQ ID NO: 407 - protein, 16 aa, Artificial Sequence
  CDR
VRDRSNGSGRRFESSN

SEQ ID NO: 408 - protein, 5 aa, Artificial Sequence
  CDR
WAYEA

SEQ ID NO: 409 - protein, 8 aa, Artificial Sequence
  CDR
GYTFTDYL

SEQ ID NO: 410 - protein, 8 aa, Artificial Sequence
  CDR
MNPVYGQV

SEQ ID NO: 411 - protein, 21 aa, Artificial Sequence
  CDR
VRDTGDGSRRHFDSINWFLDL

SEQ ID NO: 412 - protein, 5 aa, Artificial Sequence
  CDR
WAFEA

SEQ ID NO: 413 - protein, 8 aa, Artificial Sequence
  CDR
GYTFTDYV

SEQ ID NO: 414 - protein, 8 aa, Artificial Sequence
  CDR
IDPPYGQV

SEQ ID NO: 415 - protein, 21 aa, Artificial Sequence
  CDR
VRDRSNGWGKRFESSNWFLDL

SEQ ID NO: 416 - protein, 8 aa, Artificial Sequence
  CDR
GYTFVDYF

SEQ ID NO: 417 - protein, 8 aa, Artificial Sequence
  CDR
MDPLNGRP

SEQ ID NO: 418 - protein, 21 aa, Artificial Sequence
  CDR
VRDKSNGSGRRFDSSNWFLDL

SEQ ID NO: 419 - protein, 5 aa, Artificial Sequence
  CDR
WAYDA

SEQ ID NO: 420 - protein, 8 aa, Artificial Sequence
  CDR
GYTFSDYI

SEQ ID NO: 421 - protein, 8 aa, Artificial Sequence
  CDR
MNPMGGQV

SEQ ID NO: 422 - protein, 5 aa, Artificial Sequence
  CDR
WAYEV

SEQ ID NO: 423 - protein, 8 aa, Artificial Sequence
  CDR
GYTFIDYI

SEQ ID NO: 424 - protein, 8 aa, Artificial Sequence
  CDR
IDPMNGRP

SEQ ID NO: 425 - protein, 21 aa, Artificial Sequence
  CDR
VRDKSNGSGKRFDSSNWFLDL

SEQ ID NO: 426 - protein, 8 aa, Artificial Sequence
  CDR
GYTFTDYI

SEQ ID NO: 427 - protein, 8 aa, Artificial Sequence
  CDR
MNPMGGRT

SEQ ID NO: 428 - protein, 8 aa, Artificial Sequence
  CDR
GYTFVDYL

SEQ ID NO: 429 - protein, 8 aa, Artificial Sequence
  CDR
MDPMNGRP

SEQ ID NO: 430 - protein, 21 aa, Artificial Sequence
  CDR
VRDKSGGSGKLFDSSNWFLDL

SEQ ID NO: 431 - protein, 8 aa, Artificial Sequence
  CDR
INPGYGQV

SEQ ID NO: 432 - protein, 8 aa, Artificial Sequence
  CDR
MDPSYGQV

SEQ ID NO: 433 - protein, 21 aa, Artificial Sequence
  CDR
VRDRSHGSGRQFESSNWFLDL

SEQ ID NO: 434 - protein, 8 aa, Artificial Sequence
  CDR
MDPSFGQM

SEQ ID NO: 435 - protein, 21 aa, Artificial Sequence
  CDR
VRDRSHGSGRLFESSNWFLDL

SEQ ID NO: 436 - protein, 8 aa, Artificial Sequence
  CDR
GYRFTDYV

SEQ ID NO: 437 - protein, 8 aa, Artificial Sequence
  CDR
MDPSFGRM

SEQ ID NO: 438 - protein, 8 aa, Artificial Sequence
  CDR
GYTFIDYV

SEQ ID NO: 439 - protein, 8 aa, Artificial Sequence
  CDR
MDPTYGRM

SEQ ID NO: 440 - protein, 8 aa, Artificial Sequence
  CDR
GYRFLDYI

SEQ ID NO: 441 - protein, 21 aa, Artificial Sequence
  CDR
VRDRSNGSGKRFESSNWFLDL

SEQ ID NO: 442 - protein, 8 aa, Artificial Sequence
  CDR
GYKFMDQL

SEQ ID NO: 443 - protein, 8 aa, Artificial Sequence
  CDR
MNPTYGQV

SEQ ID NO: 444 - protein, 13 aa, Artificial Sequence
  CDR
ARGPSGENYPFHY

SEQ ID NO: 445 - protein, 4 aa, Artificial Sequence
  CDR
RHII

SEQ ID NO: 446 - protein, 5 aa, Artificial Sequence
  CDR
NTYEF

SEQ ID NO: 447 - protein, 8 aa, Artificial Sequence
  CDR
GYNFVDSR

SEQ ID NO: 448 - protein, 8 aa, Artificial Sequence
  CDR
INPLQGGV

SEQ ID NO: 449 - protein, 13 aa, Artificial Sequence
  CDR
ARGIDGKSYPFHF

SEQ ID NO: 450 - protein, 5 aa, Artificial Sequence
  CDR
SILEF

SEQ ID NO: 451 - protein, 8 aa, Artificial Sequence
  CDR
GYTFTKYF

SEQ ID NO: 452 - protein, 8 aa, Artificial Sequence
  CDR
IHPRTGAV

SEQ ID NO: 453 - protein, 18 aa, Artificial Sequence
  CDR
ARGAFEADSYGSSYPFHH

SEQ ID NO: 454 - protein, 5 aa, Artificial Sequence
  CDR
GNYNP

SEQ ID NO: 455 - protein, 5 aa, Artificial Sequence
  CDR
ASFEF

SEQ ID NO: 456 - protein, 8 aa, Artificial Sequence
  CDR
GYTFTKYT

SEQ ID NO: 457 - protein, 18 aa, Artificial Sequence
  CDR
ARGAFEADLSGPTYPFHH

SEQ ID NO: 458 - protein, 8 aa, Artificial Sequence
  CDR
GFNFIDSV

SEQ ID NO: 459 - protein, 8 aa, Artificial Sequence
  CDR
IKPLRGAV

SEQ ID NO: 460 - protein, 13 aa, Artificial Sequence
  CDR
AKGAFRGGSPFGF

SEQ ID NO: 461 - protein, 5 aa, Artificial Sequence
  CDR
ASREF

SEQ ID NO: 462 - protein, 8 aa, Artificial Sequence
  CDR
MNPMTGQM

SEQ ID NO: 463 - protein, 13 aa, Artificial Sequence
  CDR
ARGDFGQNYPFHY

SEQ ID NO: 464 - protein, 4 aa, Artificial Sequence
  CDR
NRYL

SEQ ID NO: 465 - protein, 5 aa, Artificial Sequence
  CDR
ASYER

SEQ ID NO: 466 - protein, 8 aa, Artificial Sequence
  CDR
GYNFMDQF

SEQ ID NO: 467 - protein, 8 aa, Artificial Sequence
  CDR
MNPIYGQV

SEQ ID NO: 468 - protein, 8 aa, Artificial Sequence
  CDR
INPLHGGV

SEQ ID NO: 469 - protein, 8 aa, Artificial Sequence
  CDR
GYTFTSYF

SEQ ID NO: 470 - protein, 8 aa, Artificial Sequence
  CDR
INPLHGAV

SEQ ID NO: 471 - protein, 13 aa, Artificial Sequence
  CDR
TRGIVADGWPYGH

SEQ ID NO: 472 - protein, 5 aa, Artificial Sequence
  CDR
SSLQF

SEQ ID NO: 473 - protein, 8 aa, Artificial Sequence
  CDR
GFTFIDHI

SEQ ID NO: 474 - protein, 14 aa, Artificial Sequence
  CDR
CKAAAPEEAFPLQY

SEQ ID NO: 475 - protein, 5 aa, Artificial Sequence
  CDR
SSRTF

SEQ ID NO: 476 - protein, 8 aa, Artificial Sequence
  CDR
GFKFIDHI

SEQ ID NO: 477 - protein, 8 aa, Artificial Sequence
  CDR
IKPLGGVA

SEQ ID NO: 478 - protein, 14 aa, Artificial Sequence
  CDR
CKAAAPDEAFPLEY

SEQ ID NO: 479 - protein, 5 aa, Artificial Sequence
  CDR
SSTTF

SEQ ID NO: 480 - protein, 7 aa, Artificial Sequence
  CDR
GFAFLDH

SEQ ID NO: 481 - protein, 8 aa, Artificial Sequence
  CDR
VKTIGGVV

SEQ ID NO: 482 - protein, 14 aa, Artificial Sequence
  CDR
SKAAAPDEAFPLEF

SEQ ID NO: 483 - protein, 8 aa, Artificial Sequence
  CDR
GFKFTEYF

SEQ ID NO: 484 - protein, 8 aa, Artificial Sequence
  CDR
LNPLRGAV

SEQ ID NO: 485 - protein, 13 aa, Artificial Sequence
  CDR
ARAVFNEAFPFDY

SEQ ID NO: 486 - protein, 8 aa, Artificial Sequence
  CDR
GFAFLDHI

SEQ ID NO: 487 - protein, 8 aa, Artificial Sequence
  CDR
GFKFIDSV

SEQ ID NO: 488 - protein, 8 aa, Artificial Sequence
  CDR
IKPLGGAV

SEQ ID NO: 489 - protein, 13 aa, Artificial Sequence
  CDR
AKGAFGGGSPFGF

SEQ ID NO: 490 - protein, 8 aa, Artificial Sequence
  CDR
IKPLRGGV

SEQ ID NO: 491 - protein, 13 aa, Artificial Sequence
  CDR
AKGAFGGSSPFGF

SEQ ID NO: 492 - protein, 8 aa, Artificial Sequence
  CDR
GFTFIKYT

SEQ ID NO: 493 - protein, 18 aa, Artificial Sequence
  CDR
ARGAFEADLYGPTYPFHH

SEQ ID NO: 494 - protein, 5 aa, Artificial Sequence
  CDR
GSYNP

SEQ ID NO: 495 - protein, 8 aa, Artificial Sequence
  CDR
GYNFVDSL

SEQ ID NO: 496 - protein, 13 aa, Artificial Sequence
  CDR
ARGIDGNSYPFHF

SEQ ID NO: 497 - protein, 8 aa, Artificial Sequence
  CDR
GYRFPDYI

SEQ ID NO: 498 - protein, 16 aa, Artificial Sequence
  CDR
VRDRSNGSGKRFESSN

SEQ ID NO: 499 - protein, 6 aa, Artificial Sequence
  CDR
NTYEFF

SEQ ID NO: 500 - protein, 11 aa, Artificial Sequence
  CDR
GYTFTTHHGHF

The invention claimed is:

1. A non-naturally occurring anti-HIV antibody, wherein the anti-HIV antibody is selected from the group consisting of:
   a. an antibody comprising a heavy chain variable region, wherein CDR H1 comprises GYKFPDYI (SEQ ID NO:405), CDR H2 comprises INPMGGQV (SEQ ID NO:406) and CDR H3 comprises VRDRSNGSGRR-FESSN (SEQ ID NO: 407); and a light chain variable region, wherein CDR L1 comprises HNL, CDR L2 comprises DFN and CDR L3 comprises WAYEA (SEQ ID NO: 408), wherein the antibody is not an antibody that consists of a heavy chain amino acid sequence of SEQ ID NO:5 and a light chain amino acid sequence of SEQ ID NO:6;
   b. an antibody comprising a heavy chain variable region, wherein CDR H1 comprises GYTFTDYV (SEQ ID NO:413), CDR H2 comprises IDPPYGQV (SEQ ID NO:414) and CDR H3 comprises VRDRSNGWGKR-FESSNWFLDL (SEQ ID NO:415); and a light chain variable region, wherein CDR L1 comprises HNL, CDR L2 comprises DFN and CDR L3 comprises WAYEA (SEQ ID NO:408), wherein the antibody is not an antibody that consists of a heavy chain amino acid sequence of SEQ ID NO:9 and a light chain amino acid sequence of SEQ ID NO:10;

c. an antibody comprising a heavy chain variable region, wherein CDR H1 comprises GYTFVDYF (SEQ ID NO:416), CDR H2 comprises MDPLNGRP (SEQ ID NO:417) and CDR H3 comprises VRDKSNGS-GRRFDSSNWFLDL (SEQ ID NO:418); and a light chain variable region, wherein CDR L1 comprises HNY, CDR L2 comprises DFN and CDR L3 comprises WAYDA (SEQ ID NO:419), wherein the antibody is not an antibody that consists of a heavy chain amino acid sequence of SEQ ID NO:13 and a light chain amino acid sequence of SEQ ID NO:14;

d. an antibody comprising a heavy chain variable region, wherein CDR H1 comprises GYTFSDYI (SEQ ID NO:420), CDR H2 comprises MNPMGGQV (SEQ ID NO:421) and CDR H3 comprises VRDRSNGSGKR-FESSNWFLDL (SEQ ID NO:441); and a light chain variable region, wherein CDR L1 comprises HNL, CDR L2 comprises DFN and CDR L3 comprises WAYEV (SEQ ID NO:422), wherein the antibody is not an antibody that consists of a heavy chain amino acid sequence of SEQ ID NO:15 and a light chain amino acid sequence of SEQ ID NO:16;

e. an antibody comprising a heavy chain variable region, wherein CDR H1 comprises GYTFIDYI (SEQ ID NO:423), CDR H2 comprises IDPMNGRP (SEQ ID NO:424) and CDR H3 comprises VRDKSNGSGKRFDSSNWFLDL (SEQ ID NO:425); and a light chain variable region, wherein CDR L1 comprises HNY, CDR L2 comprises DFN and CDR L3 comprises WAYDA (SEQ ID NO:419), wherein the antibody is not an antibody that consists of a heavy chain amino acid sequence of SEQ ID NO:17 and a light chain amino acid sequence of SEQ ID NO:18;

f. an antibody comprising a heavy chain variable region, wherein CDR H1 comprises GYTFTDYI (SEQ ID NO:426), CDR H2 comprises MNPMGGRT (SEQ ID NO:427) and CDR H3 comprises VRDKSNGSGKRFDSSNWFLDL (SEQ ID NO:425); and a light chain variable region, wherein CDR L1 comprises HNL, CDR L2 comprises DFN and CDR L3 comprises WAYEA (SEQ ID NO:408), wherein the antibody is not an antibody that consists of a heavy chain amino acid sequence of SEQ ID NO:19 and a light chain amino acid sequence of SEQ ID NO:20;

g. an antibody comprising a heavy chain variable region, wherein CDR H1 comprises GYTFVDYL (SEQ ID NO:428), CDR H2 comprises MDPMNGRP (SEQ ID NO:429) and CDR H3 comprises VRDKSGGSGKLFDSSNWFLDL (SEQ ID NO:430); and a light chain variable region, wherein CDR L1 comprises HNY, CDR L2 comprises DFN and CDR L3 comprises WAYDA (SEQ ID NO:419), wherein the antibody is not an antibody that consists of a heavy chain amino acid sequence of SEQ ID NO: 21 and a light chain amino acid sequence of SEQ ID NO:22;

h. an antibody comprising a heavy chain variable region, wherein CDR H1 comprises GYTFTDYV (SEQ ID NO:413), CDR H2 comprises INPGYGQV (SEQ ID NO:431) and CDR H3 comprises VRDRSNGWGKR-FESSNWFLDL (SEQ ID NO:415); and a light chain variable region, wherein CDR L1 comprises HNL, CDR L2 comprises DEN and CDR L3 comprises WAYEA (SEQ ID NO:408), wherein the antibody is not an antibody that consists of a heavy chain amino acid sequence of SEQ ID NO: 23 and a light chain amino acid sequence of SEQ ID NO:24;

i. an antibody comprising a heavy chain variable region, wherein CDR H1 comprises GYTFTDYV (SEQ ID NO:413), CDR H2 comprises MDPSYGQV (SEQ ID NO:432) and CDR H3 comprises VRDRSHGS-GRQFESSNWFLDL (SEQ ID NO:433); and a light chain variable region, wherein CDR L1 comprises HNL, CDR L2 comprises DFN and CDR L3 comprises WAYEA (SEQ ID NO:408), wherein the antibody is not an antibody that consists of a heavy chain amino acid sequence of SEQ ID NO:25 and a light chain amino acid sequence of SEQ ID NO:26;

j. an antibody comprising a heavy chain variable region, wherein CDR H1 comprises GYTFTDYV (SEQ ID NO:413), CDR H2 comprises MDPSFGQM (SEQ ID NO:434) and CDR H3 comprises VRDRSHGS-GRLFESSNWFLDL (SEQ ID NO:435); and a light chain variable region, wherein CDR L1 comprises HNL, CDR L2 comprises DFN and CDR L3 comprises WAYEA (SEQ ID NO:408), wherein the antibody is not an antibody that consists of a heavy chain amino acid sequence of SEQ ID NO:27 and a light chain amino acid sequence of SEQ ID NO:28;

k. an antibody comprising a heavy chain variable region, wherein CDR H1 comprises GYRFTDYV (SEQ ID NO:436), CDR H2 comprises MDPSFGRM (SEQ ID NO:437) and CDR H3 comprises VRDRSHGS-GRLFESSNWFLDL (SEQ ID NO:435); and a light chain variable region, wherein CDR L1 comprises HNL, CDR L2 comprises DFN and CDR L3 comprises WAYEA (SEQ ID NO:408), wherein the antibody is not an antibody that consists of a heavy chain amino acid sequence of SEQ ID NO:29 and a light chain amino acid sequence of SEQ ID NO:30;

l. an antibody comprising a heavy chain variable region, wherein CDR H1 comprises GYTFIDYV (SEQ ID NO:438), CDR H2 comprises MDPTYGRM (SEQ ID NO:439) and CDR H3 comprises VRDRSHGS-GRLFESSNWFLDL (SEQ ID NO:435); and a light chain variable region, wherein CDR L1 comprises HNL, CDR L2 comprises DFN and CDR L3 comprises WAYEA (SEQ ID NO:408), wherein the antibody is not an antibody that consists of a heavy chain amino acid sequence of SEQ ID NO:31 and a light chain amino acid sequence of SEQ ID NO:32;

m. an antibody comprising a heavy chain variable region, wherein CDR H1 comprises GYRFLDYI (SEQ ID NO:440), CDR H2 comprises MNPMGGQV (SEQ ID NO:421) and CDR H3 comprises VRDRSNGSGKR-FESSNWFLDL (SEQ ID NO:441); and a light chain variable region, wherein CDR L1 comprises HNL, CDR L2 comprises DFN and CDR L3 comprises WAYEA (SEQ ID NO:408), wherein the antibody is not an antibody that consists of a heavy chain amino acid sequence of SEQ ID NO:33 and a light chain amino acid sequence of SEQ ID NO 34;

n. an antibody comprising a heavy chain variable region, wherein CDR H1 comprises GYNFVDSR (SEQ ID NO:447), CDR H2 comprises INPLQGGV (SEQ ID NO:448) and CDR H3 comprises ARGIDGKSYPFHF (SEQ ID NO: 449); and a light chain variable region, wherein CDR L1 comprises S, CDR L2 comprises ESS and CDR L3 comprises SILEF (SEQ ID NO:450), wherein the antibody is not an antibody that consists of a heavy chain amino acid sequence of SEQ ID NO:37 and a light chain amino acid sequence of SEQ ID NO:38;

o. an antibody comprising a heavy chain variable region, wherein CDR H1 comprises GYTFTTHHGHF (SEQ ID NO:500), CDR H2 comprises MNPMTGQM (SEQ ID NO:462) and CDR H3 comprises ARGDFGQNYPFHY (SEQ ID NO:463); and a light chain variable region, wherein CDR L1 comprises NRYL (SEQ ID NO:464), CDR L2 comprises DDN and CDR L3 comprises ASYER (SEQ ID NO:465), wherein the antibody is not an antibody that consists of a heavy chain amino acid sequence of SEQ ID NO:39 and a light chain amino acid sequence of SEQ ID NO:40;

p. an antibody comprising a heavy chain variable region, wherein CDR H1 comprises GYNFMDQF (SEQ ID NO:466), CDR H2 comprises MNPIYGQV (SEQ ID NO:467) and CDR H3 comprises ARGPSGENYPFHY (SEQ ID NO: 444); and a light chain variable region, wherein CDR L1 comprises RHII (SEQ ID NO:445), CDR L2 comprises DDD and CDR L3 comprises NTYEF (SEQ ID NO:446), wherein the antibody is not an antibody that consists of a heavy chain amino acid sequence of SEQ ID NO:41 and a light chain amino acid sequence of SEQ ID NO:42;

q. an antibody comprising a heavy chain variable region, wherein CDR H1 comprises GYNFVDSR (SEQ ID NO:447), CDR H2 comprises INPLHGGV (SEQ ID NO:468) and CDR H3 comprises ARGIDGKSYPFHF (SEQ ID NO: 449); and a light chain variable region, wherein CDR L1 comprises S, CDR L2 comprises ESS and CDR L3 comprises SILEF (SEQ ID NO:450), wherein the antibody is not an antibody that consists of a heavy chain amino acid sequence of SEQ ID NO:43 and a light chain amino acid sequence of SEQ ID NO:44;

r. an antibody comprising a heavy chain variable region, wherein CDR H1 comprises GYTFTKYF (SEQ ID NO:451), CDR H2 comprises IHPRTGAV (SEQ ID NO:452) and CDR H3 comprises ARGAFEADSYGSSYPFHH (SEQ ID NO:453); and a light chain variable region, wherein CDR L1 comprises GNYNP (SEQ ID NO:454), CDR L2 comprises EDN and CDR L3 comprises ASFEF (SEQ ID NO:455), wherein the antibody is not an antibody that consists of a heavy chain amino acid sequence of SEQ ID NO:45 and a light chain amino acid sequence of SEQ ID NO:46;

s. an antibody comprising a heavy chain variable region, wherein CDR H1 comprises GYTFTKYT (SEQ ID NO:456), CDR H2 comprises IHPRTGAV (SEQ ID NO:452) and CDR H3 comprises ARGAFEADLSGPTYPFHH (SEQ ID NO:457); and a light chain variable region, wherein CDR L1 comprises GNYNP (SEQ ID NO:454), CDR L2 comprises EDN and CDR L3 comprises ASFEF (SEQ ID NO:455), wherein the antibody is not an antibody that consists of a heavy chain amino acid sequence of SEQ ID NO:47 and a light chain amino acid sequence of SEQ ID NO:48;

t. an antibody comprising a heavy chain variable region, wherein CDR H1 comprises GFNFIDSV (SEQ ID NO:458), CDR H2 comprises IKPLRGAV (SEQ ID NO:459) and CDR H3 comprises AKGAFRGGSPFGF (SEQ ID NO: 460); and a light chain variable region, wherein CDR L1 comprises DVT and CDR L2 comprises ASREF (SEQ ID NO:461), wherein the antibody is not an antibody that consists of a heavy chain amino acid sequence of SEQ ID NO: 49 and a light chain amino acid sequence of SEQ ID NO:50;

u. an antibody comprising a heavy chain variable region, wherein CDR H1 comprises GYTFTSYF (SEQ ID NO:469), CDR H2 comprises INPLHGAV (SEQ ID NO:470) and CDR H3 comprises TRGIVADGWPYGH (SEQ ID NO: 471); and a light chain variable region, wherein CDR L1 comprises S, CDR L2 comprises EGA and CDR L3 comprises SSLQF (SEQ ID NO:472), wherein the antibody is not an antibody that consists of a heavy chain amino acid sequence of SEQ ID NO:51 and a light chain amino acid sequence of SEQ ID NO:52;

v. an antibody comprising a heavy chain variable region, wherein CDR H1 comprises GFTFIDHI (SEQ ID NO:473), CDR H2 comprises IKPLRGAV (SEQ ID NO:459) and CDR H3 comprises CKAAAPEEAFPLQY (SEQ ID NO: 474); and a light chain variable region, wherein CDR L1 comprises NVD, CDR L2 comprises DNN and CDR L3 comprises SSRTF (SEQ ID NO:475), wherein the antibody is not an antibody that consists of a heavy chain amino acid sequence of SEQ ID NO:53 and a light chain amino acid sequence of SEQ ID NO:54;

w. an antibody comprising a heavy chain variable region, wherein CDR H1 comprises GFKFIDHI (SEQ ID NO:476), CDR H2 comprises IKPLGGVA (SEQ ID NO:477) and CDR H3 comprises CKAAAPDEAFPLEY (SEQ ID NO: 478); and a light chain variable region, wherein CDR L1 comprises NVD, CDR L2 comprises DNN and CDR L3 comprises SSTTF (SEQ ID NO:479), wherein the antibody is not an antibody that consists of a heavy chain amino acid sequence of SEQ ID NO:55 and a light chain amino acid sequence of SEQ ID NO:56;

x. an antibody comprising a heavy chain variable region, wherein CDR H1 comprises GFAFLDH (SEQ ID NO:480), CDR H2 comprises VKTIGGVV (SEQ ID NO:481) and CDR H3 comprises SKAAAPDEAFPLEF (SEQ ID NO: 482); and a light chain variable region, wherein CDR L1 comprises NVD, CDR L2 comprises DNN and CDR L3 comprises SSTTF (SEQ ID NO:479), wherein the antibody is not an antibody that consists of a heavy chain amino acid sequence of SEQ ID NO:57 and a light chain amino acid sequence of SEQ ID NO:58;

y. an antibody comprising a heavy chain variable region, wherein CDR H1 comprises GFKFTEYF (SEQ ID NO:483), CDR H2 comprises LNPLRGAV (SEQ ID NO:484) and CDR H3 comprises ARAVFNEAFPFDY (SEQ ID NO: 485); and a light chain variable region, wherein CDR L1 comprises VS, CDR L2 comprises DGD and CDR L3 comprises ASREF (SEQ ID NO:461), wherein the antibody is not an antibody that consists of a heavy chain amino acid sequence of SEQ ID NO:61 and a light chain amino acid sequence of SEQ ID NO:62;

z. an antibody comprising a heavy chain variable region, wherein CDR H1 comprises GFKFIDHI (SEQ ID NO:476), CDR H2 comprises IKPLGGVA (SEQ ID NO:477) and CDR H3 comprises CKAAAPDEAFPLEY (SEQ ID NO: 478); and a light chain variable region, wherein CDR L1 comprises NVD, CDR L2 comprises DND and CDR L3 comprises SSTTF (SEQ ID NO:479), wherein the antibody is not an antibody that consists of a heavy chain amino acid sequence of SEQ ID NO:63 and a light chain amino acid sequence of SEQ ID NO:64;

aa. an antibody comprising a heavy chain variable region, wherein CDR H1 comprises GFAFLDHI (SEQ ID NO:486), CDR H2 comprises VKTIGGVV (SEQ ID NO:481) and CDR H3 comprises SKAAAPDEAF-PLEF (SEQ ID NO: 482); and a light chain variable region, wherein CDR L1 comprises NVD, CDR L2 comprises DNN and CDR L3 comprises SSTTF (SEQ ID NO:479), wherein the antibody is not an antibody that consists of a heavy chain amino acid sequence of SEQ ID NO:65 and a light chain amino acid sequence of SEQ ID NO:66;

bb. an antibody comprising a heavy chain variable region, wherein CDR H1 comprises GFKFIDSV (SEQ ID NO:487), CDR H2 comprises IKPLGGAV (SEQ ID NO:488) and CDR H3 comprises AKGAFGGGSPFGF (SEQ ID NO: 489); and a light chain variable region, wherein CDR L1 comprises DVT and CDR L2 comprises ASREF (SEQ ID NO:461), wherein the antibody is not an antibody that consists of a heavy chain amino acid sequence of SEQ ID NO: 67 and a light chain amino acid sequence of SEQ ID NO:68;

cc. an antibody comprising a heavy chain variable region, wherein CDR H1 comprises GFNFIDSV (SEQ ID NO:458), CDR H2 comprises IKPLRGGV (SEQ ID NO:490) and CDR H3 comprises AKGAFGGSSPFGF (SEQ ID NO: 491); and a light chain variable region, wherein CDR L1 comprises DVT and CDR L2 comprises ASREF (SEQ ID NO:461), wherein the antibody is not an antibody that consists of a heavy chain amino acid sequence of SEQ ID NO: 69 and a light chain amino acid sequence of SEQ ID NO:70;

dd. an antibody comprising a heavy chain variable region, wherein CDR H1 comprises GFTFIKYT (SEQ ID NO:492), CDR H2 comprises IHPRTGAV (SEQ ID NO:452) and CDR H3 comprises ARGAFEADLYGP-TYPFHH (SEQ ID NO:493); and a light chain variable region, wherein CDR L1 comprises GSYNP (SEQ ID NO:494), CDR L2 comprises DDN and CDR L3 comprises ASFEF (SEQ ID NO:455), wherein the antibody is not an antibody that consists of a heavy chain amino acid sequence of SEQ ID NO:73 and a light chain amino acid sequence of SEQ ID NO:74;

ee. an antibody comprising a heavy chain variable region, wherein CDR H1 comprises GYNFVDSL (SEQ ID NO:495), CDR H2 comprises INPLQGGV (SEQ ID NO:448) and CDR H3 comprises ARGIDGNSYPFHF (SEQ ID NO: 496); and a light chain variable region, wherein CDR L1 comprises S, CDR L2 comprises ESS and CDR L3 comprises SILEF (SEQ ID NO:450), wherein the antibody is not an antibody that consists of a heavy chain amino acid sequence of SEQ ID NO:75 and a light chain amino acid sequence of SEQ ID NO:76;

ff. an antibody comprising a heavy chain variable region, wherein CDR H1 comprises GYRFPDYI (SEQ ID NO:497), CDR H2 comprises MNPMGGQV (SEQ ID NO:421) and CDR H3 comprises VRDRSNGSGKR-FESSNWFLDL (SEQ ID NO:441); and a light chain variable region, wherein CDR L1 comprises HNY, CDR L2 comprises DFN and CDR L3 comprises WAYDA (SEQ ID NO:419);

gg. an antibody comprising a heavy chain variable region, wherein CDR H1 comprises GFAFLDHI (SEQ ID NO:486), CDR H2 comprises VKTIGGVV (SEQ ID NO:481) and CDR H3 comprises SKAAAPDEAF-PLEF (SEQ ID NO:482); and a light chain variable region, wherein CDR L1 comprises NVD, CDR L2 comprises DNN and CDR L3 comprises SSTTF (SEQ ID NO:479), wherein the antibody is not an antibody that consists of a heavy chain amino acid sequence of SEQ ID NO:59 and a light chain amino acid sequence of SEQ ID NO:60; and hh. an antibody comprising a heavy chain variable region, wherein CDR H1 comprises GFNFIDSV (SEQ ID NO:458), CDR H2 comprises IKPLRGGV (SEQ ID NO:490) and CDR H3 comprises AKGAFGGSSPFGF (SEQ ID NO:491); and a light chain variable region, wherein CDR L2 comprises DVT and CDR L3 comprises ASFEF (SEQ ID NO:455), wherein the antibody is not an antibody that consists of a heavy chain amino acid sequence of SEQ ID NO:71 and a light chain amino acid sequence of SEQ ID NO: 72.

2. A pharmaceutical composition comprising one or more anti-HIV antibodies of claim 1, and a pharmaceutically acceptable carrier.

3. A method for treating HIV infection in a subject, comprising administering to the subject infected with HIV an effective amount of the composition of claim 1.

4. The anti-HIV antibody of claim 1, wherein the anti-HIV antibody comprises a heavy chain variable region, wherein CDR H1 comprises GYKFPDYI (SEQ ID NO:405), CDR H2 comprises INPMGGQV (SEQ ID NO:406) and CDR H3 comprises VRDRSNGSGRRFESSN (SEQ ID NO:407); and a light chain variable region, wherein CDR L1 comprises HNL, CDR L2 comprises DFN and CDR L3 comprises WAYEA (SEQ ID NO:408), wherein the antibody is not an antibody that consists of a heavy chain amino acid sequence of SEQ ID NO:5 and a light chain amino acid sequence of SEQ ID NO:6.

5. The anti-HIV antibody of claim 1, wherein the anti-HIV antibody comprises a heavy chain variable region, wherein CDR H1 comprises GYTFTDYV (SEQ ID NO:413), CDR H2 comprises IDPPYGQV (SEQ ID NO:414) and CDR H3 comprises VRDRSNGWGKR-FESSNWFLDL (SEQ ID NO:415); and a light chain variable region, wherein CDR L1 comprises HNL, CDR L2 comprises DFN and CDR L3 comprises WAYEA (SEQ ID NO:408), wherein the antibody is not an antibody that consists of a heavy chain amino acid sequence of SEQ ID NO: 9 and a light chain amino acid sequence of SEQ ID NO:10.

6. The anti-HIV antibody of claim 1, wherein the anti-HIV antibody comprises a heavy chain variable region, wherein CDR H1 comprises GYTFVDYF (SEQ ID NO:416), CDR H2 comprises MDPLNGRP (SEQ ID NO:417) and CDR H3 comprises VRDKSNGS-GRRFDSSNWFLDL (SEQ ID NO:418); and a light chain variable region, wherein CDR L1 comprises HNY, CDR L2 comprises DFN and CDR L3 comprises WAYDA (SEQ ID NO:419), wherein the antibody is not an antibody that consists of a heavy chain amino acid sequence of SEQ ID NO: 13 and a light chain amino acid sequence of SEQ ID NO:14.

7. The anti-HIV antibody of claim 1, wherein the anti-HIV antibody comprises a heavy chain variable region, wherein CDR H1 comprises GYTFSDYI (SEQ ID NO:420), CDR H2 comprises MNPMGGQV (SEQ ID NO:421) and CDR H3 comprises VRDRSNGSGKRFESSNWFLDL (SEQ ID NO:441); and a light chain variable region, wherein CDR L1 comprises HNL, CDR L2 comprises DFN and CDR L3 comprises WAYEV (SEQ ID NO:422), wherein the antibody is not an antibody that consists of a heavy chain amino acid sequence of SEQ ID NO: 15 and a light chain amino acid sequence of SEQ ID NO:16.

8. The anti-HIV antibody of claim 1, wherein the anti-HIV antibody comprises a heavy chain variable region, wherein CDR H1 comprises GYTFIDYI (SEQ ID NO:423), CDR H2 comprises IDPMNGRP (SEQ ID NO:424) and CDR H3 comprises VRDKSNGSGKRFDSSNWFLDL (SEQ ID NO:425); and a light chain variable region, wherein CDR L1 comprises HNY, CDR L2 comprises DFN and CDR L3 comprises WAYDA (SEQ ID NO:419), wherein the antibody is not an antibody that consists of a heavy chain amino acid sequence of SEQ ID NO: 17 and a light chain amino acid sequence of SEQ ID NO:18.

9. The anti-HIV antibody of claim 1, wherein the anti-HIV antibody comprises a heavy chain variable region, wherein CDR H1 comprises GYTFTDYI (SEQ ID NO:426), CDR H2 comprises MNPMGGRT (SEQ ID NO:427) and CDR H3 comprises VRDKSNGSGKRFDSSNWFLDL (SEQ ID NO:425); and a light chain variable region, wherein CDR L1 comprises HNL, CDR L2 comprises DFN and CDR L3 comprises WAYEA (SEQ ID NO:408), wherein the antibody is not an antibody that consists of a heavy chain amino acid sequence of SEQ ID NO: 19 and a light chain amino acid sequence of SEQ ID NO:20.

10. The anti-HIV antibody of claim 1, wherein the anti-HIV antibody comprises a heavy chain variable region, wherein CDR H1 comprises GYTFVDYL (SEQ ID NO:428), CDR H2 comprises MDPMNGRP (SEQ ID NO:429) and CDR H3 comprises VRDKSGGSGKLFDSSNWFLDL (SEQ ID NO:430); and a light chain variable region, wherein CDR L1 comprises HNY, CDR L2 comprises DFN and CDR L3 comprises WAYDA (SEQ ID NO:419), wherein the antibody is not an antibody that consists of a heavy chain amino acid sequence of SEQ ID NO: 21 and a light chain amino acid sequence of SEQ ID NO:22.

11. The anti-HIV antibody of claim 1, wherein the anti-HIV antibody comprises a heavy chain variable region, wherein CDR H1 comprises GYTFTDYV (SEQ ID NO:413), CDR H2 comprises INPGYGQV (SEQ ID NO:431) and CDR H3 comprises VRDRSNGWGKRFESSNWFLDL (SEQ ID NO:415); and a light chain variable region, wherein CDR L1 comprises HNL, CDR L2 comprises DFN and CDR L3 comprises WAYEA (SEQ ID NO:408), wherein the antibody is not an antibody that consists of a heavy chain amino acid sequence of SEQ ID NO: 23 and a light chain amino acid sequence of SEQ ID NO:24.

12. The anti-HIV antibody of claim 1, wherein the anti-HIV antibody comprises a heavy chain variable region, wherein CDR H1 comprises GYTFTDYV (SEQ ID NO:413), CDR H2 comprises MDPSYGQV (SEQ ID NO:432) and CDR H3 comprises VRDRSHGS-GRQFESSNWFLDL (SEQ ID NO:433); and a light chain variable region, wherein CDR L1 comprises HNL, CDR L2 comprises DFN and CDR L3 comprises WAYEA (SEQ ID NO:408), wherein the antibody is not an antibody that consists of a heavy chain amino acid sequence of SEQ ID NO: 25 and a light chain amino acid sequence of SEQ ID NO:26.

13. The anti-HIV antibody of claim 1, wherein the anti-HIV antibody comprises a heavy chain variable region, wherein CDR H1 comprises GYTFTDYV (SEQ ID NO:413), CDR H2 comprises MDPSFGQM (SEQ ID NO:434) and CDR H3 comprises VRDRSHGS-GRLFESSNWFLDL (SEQ ID NO:435); and a light chain variable region, wherein CDR L1 comprises HNL, CDR L2 comprises DFN and CDR L3 comprises WAYEA (SEQ ID NO:408), wherein the antibody is not an antibody that consists of a heavy chain amino acid sequence of SEQ ID NO: 27 and a light chain amino acid sequence of SEQ ID NO:28.

14. The anti-HIV antibody of claim 1, wherein the anti-HIV antibody comprises a heavy chain variable region, wherein CDR H1 comprises GYRFTDYV (SEQ ID NO:436), CDR H2 comprises MDPSFGRM (SEQ ID NO:437) and CDR H3 comprises VRDRSHGS-GRLFESSNWFLDL (SEQ ID NO:435); and a light chain variable region, wherein CDR L1 comprises HNL, CDR L2 comprises DFN and CDR L3 comprises WAYEA (SEQ ID NO:408), wherein the antibody is not an antibody that consists of a heavy chain amino acid sequence of SEQ ID NO: 29 and a light chain amino acid sequence of SEQ ID NO:30.

15. The anti-HIV antibody of claim 1, wherein the anti-HIV antibody comprises a heavy chain variable region, wherein CDR H1 comprises GYTFIDYV (SEQ ID NO:438), CDR H2 comprises MDPTYGRM (SEQ ID NO:439) and CDR H3 comprises VRDRSHGS-GRLFESSNWFLDL (SEQ ID NO:435); and a light chain variable region, wherein CDR L1 comprises HNL, CDR L2 comprises DFN and CDR L3 comprises WAYEA (SEQ ID NO:408), wherein the antibody is not an antibody that consists of a heavy chain amino acid sequence of SEQ ID NO: 31 and a light chain amino acid sequence of SEQ ID NO:32.

16. The anti-HIV antibody of claim 1, wherein the anti-HIV antibody comprises a heavy chain variable region, wherein CDR H1 comprises GYRFLDYI (SEQ ID NO:440), CDR H2 comprises MNPMGGQV (SEQ ID NO:421) and CDR H3 comprises VRDRSNGSGKR-FESSNWFLDL (SEQ ID NO:441); and a light chain variable region, wherein CDR L1 comprises HNL, CDR L2 comprises DFN and CDR L3 comprises WAYEA (SEQ ID NO:408), wherein the antibody is not an antibody that consists of a heavy chain amino acid sequence of SEQ ID NO: 33 and a light chain amino acid sequence of SEQ ID NO 34.

17. The anti-HIV antibody of claim 1, wherein the anti-HIV antibody comprises a heavy chain variable region, wherein CDR H1 comprises GYNFVDSR (SEQ ID NO:447), CDR H2 comprises INPLQGGV (SEQ ID NO:448) and CDR H3 comprises ARGIDGKSYPFHF (SEQ ID NO: 449); and a light chain variable region, wherein CDR L1 comprises S, CDR L2 comprises ESS and CDR L3 comprises SILEF (SEQ ID NO:450), wherein the antibody is not an antibody that consists of a heavy chain amino acid sequence of SEQ ID NO:37 and a light chain amino acid sequence of SEQ ID NO:38.

18. The anti-HIV antibody of claim 1, wherein the anti-HIV antibody comprises a heavy chain variable region, wherein CDR H1 comprises GYTFTTHHGHF (SEQ ID NO:500), CDR H2 comprises MNPMTGQM (SEQ ID NO:462) and CDR H3 comprises ARGDFGQNYPFHY (SEQ ID NO:463); and a light chain variable region, wherein CDR L1 comprises NRYL (SEQ ID NO:464), CDR L2 comprises DDN and CDR L3 comprises ASYER (SEQ ID NO:465), wherein the antibody is not an antibody that consists of a heavy chain amino acid sequence of SEQ ID NO:39 and a light chain amino acid sequence of SEQ ID NO: 40.

19. The anti-HIV antibody of claim 1, wherein the anti-HIV antibody comprises a heavy chain variable region, wherein CDR H1 comprises GYNFMDQF (SEQ ID NO:466), CDR H2 comprises MNPIYGQV (SEQ ID NO:467) and CDR H3 comprises ARGPSGENYPFHY (SEQ ID NO:444); and a light chain variable region, wherein CDR L1 comprises RHII (SEQ ID NO:445), CDR L2 comprises DDD and CDR L3 comprises NTYEF (SEQ ID NO:446), wherein the antibody is not an antibody that consists of a heavy chain amino acid sequence of SEQ ID NO:41 and a light chain amino acid sequence of SEQ ID NO: 42.

20. The anti-HIV antibody of claim 1, wherein the anti-HIV antibody comprises a heavy chain variable region, wherein CDR H1 comprises GYNFVDSR (SEQ ID NO:447), CDR H2 comprises INPLHGGV (SEQ ID NO:468) and CDR H3 comprises ARGIDGKSYPFHF (SEQ ID NO: 449); and a light chain variable region, wherein CDR L1 comprises S, CDR L2 comprises ESS and CDR L3 comprises SILEF (SEQ ID NO:450), wherein the antibody is not an antibody that consists of a heavy chain amino acid sequence of SEQ ID NO:43 and a light chain amino acid sequence of SEQ ID NO:44.

21. The anti-HIV antibody of claim 1, wherein the anti-HIV antibody comprises a heavy chain variable region, wherein CDR H1 comprises GYTFTKYF (SEQ ID NO:451), CDR H2 comprises IHPRTGAV (SEQ ID NO:452) and CDR H3 comprises ARGAFEADSYGSSYPFHH (SEQ ID NO:453); and a light chain variable region, wherein CDR L1 comprises GNYNP (SEQ ID NO:454), CDR L2 comprises EDN and CDR L3 comprises ASFEF (SEQ ID NO:455), wherein the antibody is not an antibody that consists of a heavy chain amino acid sequence of SEQ ID NO: 45 and a light chain amino acid sequence of SEQ ID NO:46.

22. The anti-HIV antibody of claim 1, wherein the anti-HIV antibody comprises a heavy chain variable region, wherein CDR H1 comprises GYTFTKYT (SEQ ID NO:456), CDR H2 comprises IHPRTGAV (SEQ ID NO:452) and CDR H3 comprises ARGAFEADLSGP-TYPFHH (SEQ ID NO:457); and a light chain variable region, wherein CDR L1 comprises GNYNP (SEQ ID NO:454), CDR L2 comprises EDN and CDR L3 comprises ASFEF (SEQ ID NO:455), wherein the antibody is not an antibody that consists of a heavy chain amino acid sequence of SEQ ID NO: 47 and a light chain amino acid sequence of SEQ ID NO:48.

23. The anti-HIV antibody of claim 1, wherein the anti-HIV antibody comprises a heavy chain variable region, wherein CDR H1 comprises GFNFIDSV (SEQ ID NO:458), CDR H2 comprises IKPLRGAV (SEQ ID NO:459) and CDR H3 comprises AKGAFRGGSPFGF (SEQ ID NO: 460); and a light chain variable region, wherein CDR L1 comprises DVT and CDR L2 comprises ASREF (SEQ ID NO:461), wherein the antibody is not an antibody that consists of a heavy chain amino acid sequence of SEQ ID NO: 49 and a light chain amino acid sequence of SEQ ID NO:50.

24. The anti-HIV antibody of claim 1, wherein the anti-HIV antibody comprises a heavy chain variable region, wherein CDR H1 comprises GYTFTSYF (SEQ ID NO:469), CDR H2 comprises INPLHGAV (SEQ ID NO:470) and CDR H3 comprises TRGIVADGWPYGH (SEQ ID NO: 471); and a light chain variable region, wherein CDR L1 comprises S, CDR L2 comprises EGA and CDR L3 comprises SSLQF (SEQ ID NO:472), wherein the antibody is not an antibody that consists of a heavy chain amino acid sequence of SEQ ID NO:51 and a light chain amino acid sequence of SEQ ID NO:52.

25. The anti-HIV antibody of claim 1, wherein the anti-HIV antibody comprises a heavy chain variable region, wherein CDR H1 comprises GFTFIDHI (SEQ ID NO:473), CDR H2 comprises IKPLRGAV (SEQ ID NO:459) and CDR H3 comprises CKAAAPEEAFPLQY (SEQ ID NO: 474); and a light chain variable region, wherein CDR L1 comprises NVD, CDR L2 comprises DNN and CDR L3 comprises SSRTF (SEQ ID NO: 475), wherein the antibody is not an antibody that consists of a heavy chain amino acid sequence of SEQ ID NO:53 and a light chain amino acid sequence of SEQ ID NO:54.

26. The anti-HIV antibody of claim 1, wherein the anti-HIV antibody comprises a heavy chain variable region, wherein CDR H1 comprises GFKFIDHI (SEQ ID NO:476), CDR H2 comprises IKPLGGVA (SEQ ID NO:477) and CDR H3 comprises CKAAAPDEAFPLEY (SEQ ID NO: 478); and a light chain variable region, wherein CDR L1 comprises NVD, CDR L2 comprises DNN and CDR L3 comprises SSTTF (SEQ ID NO: 479), wherein the antibody is not an antibody that consists of a heavy chain amino acid sequence of SEQ ID NO:55 and a light chain amino acid sequence of SEQ ID NO:56.

27. The anti-HIV antibody of claim 1, wherein the anti-HIV antibody comprises a heavy chain variable region, wherein CDR H1 comprises GFAFLDH (SEQ ID NO:480), CDR H2 comprises VKTIGGVV (SEQ ID NO:481) and CDR H3 comprises SKAAAPDEAFPLEF (SEQ ID NO: 482); and a light chain variable region, wherein CDR L1 comprises NVD, CDR L2 comprises DNN and CDR L3 comprises SSTTF (SEQ ID NO: 479), wherein the antibody is not an antibody that consists of a heavy chain amino acid sequence of SEQ ID NO:57 and a light chain amino acid sequence of SEQ ID NO:58.

28. The anti-HIV antibody of claim 1, wherein the anti-HIV antibody comprises a heavy chain variable region, wherein CDR H1 comprises GFKFTEYF (SEQ ID NO:483), CDR H2 comprises LNPLRGAV (SEQ ID NO:484) and CDR H3 comprises ARAVFNEAFPFDY (SEQ ID NO: 485); and a light chain variable region, wherein CDR L1 comprises VS, CDR L2 comprises DGD and CDR L3 comprises ASREF (SEQ ID NO:461), wherein the antibody is not an antibody that consists of a heavy chain amino acid sequence of SEQ ID NO:61 and a light chain amino acid sequence of SEQ ID NO:62.

29. The anti-HIV antibody of claim 1, wherein the anti-HIV antibody comprises a heavy chain variable region, wherein CDR H1 comprises GFKFIDHI (SEQ ID NO:476), CDR H2 comprises IKPLGGVA (SEQ ID NO:477) and CDR H3 comprises CKAAAPDEAFPLEY (SEQ ID NO: 478); and a light chain variable region, wherein CDR L1 comprises NVD, CDR L2 comprises DND and CDR L3 comprises SSTTF (SEQ ID NO: 479), wherein the antibody is not an antibody that consists of a heavy chain amino acid sequence of SEQ ID NO:63 and a light chain amino acid sequence of SEQ ID NO:64.

30. The anti-HIV antibody of claim 1, wherein the anti-HIV antibody comprises a heavy chain variable region, wherein CDR H1 comprises GFAFLDHI (SEQ ID NO:486), CDR H2 comprises VKTIGGVV (SEQ ID NO:481) and CDR H3 comprises SKAAAPDEAFPLEF (SEQ ID NO: 482); and a light chain variable region, wherein CDR L1 comprises NVD, CDR L2 comprises DNN and CDR L3 comprises SSTTF (SEQ ID NO: 479), wherein the antibody is not an antibody that consists of a heavy chain amino acid sequence of SEQ ID NO:65 and a light chain amino acid sequence of SEQ ID NO:66.

31. The anti-HIV antibody of claim 1, wherein the anti-HIV antibody comprises a heavy chain variable region, wherein CDR H1 comprises GFKFIDSV (SEQ ID NO:487), CDR H2 comprises IKPLGGAV (SEQ ID NO:488) and CDR H3 comprises AKGAFGGGSPFGF (SEQ ID NO: 489); and a light chain variable region, wherein CDR L1 comprises DVT and CDR L2 comprises ASREF (SEQ ID NO:461), wherein the antibody is not an antibody that consists of a heavy chain amino acid sequence of SEQ ID NO: 67 and a light chain amino acid sequence of SEQ ID NO:68.

32. The anti-HIV antibody of claim 1, wherein the anti-HIV antibody comprises a heavy chain variable region, wherein CDR H1 comprises GFNFIDSV (SEQ ID NO:458), CDR H2 comprises IKPLRGGV (SEQ ID NO:490) and CDR H3 comprises AKGAFGGSSPFGF (SEQ ID NO: 491); and a light chain variable region, wherein CDR L1 comprises DVT and CDR L2 comprises ASREF (SEQ ID NO:461), wherein the antibody is not an antibody that consists of a heavy chain amino acid sequence of SEQ ID NO: 69 and a light chain amino acid sequence of SEQ ID NO:70.

33. The anti-HIV antibody of claim 1, wherein the anti-HIV antibody comprises a heavy chain variable region, wherein CDR H1 comprises GFTFIKYT (SEQ ID NO:492), CDR H2 comprises IHPRTGAV (SEQ ID NO:452) and CDR H3 comprises ARGAFEADLYGPTYPFHH (SEQ ID NO:493); and a light chain variable region, wherein CDR L1 comprises GSYNP (SEQ ID NO:494), CDR L2 comprises DDN and CDR L3 comprises ASFEF (SEQ ID NO:455), wherein the antibody is not an antibody that consists of a heavy chain amino acid sequence of SEQ ID NO: 73 and a light chain amino acid sequence of SEQ ID NO:74.

34. The anti-HIV antibody of claim 1, wherein the anti-HIV antibody comprises a heavy chain variable region, wherein CDR H1 comprises GYNFVDSL (SEQ ID NO:495), CDR H2 comprises INPLQGGV (SEQ ID NO:448) and CDR H3 comprises ARGIDGNSYPFHF (SEQ ID NO: 496); and a light chain variable region, wherein CDR L1 comprises S, CDR L2 comprises ESS and CDR L3 comprises SILEF (SEQ ID NO:450), wherein the antibody is not an antibody that consists of a heavy chain amino acid sequence of SEQ ID NO:75 and a light chain amino acid sequence of SEQ ID NO:76.

35. The anti-HIV antibody of claim 1, wherein the anti-HIV antibody comprises a heavy chain variable region, wherein CDR H1 comprises GYRFPDYI (SEQ ID NO:497), CDR H2 comprises MNPMGGQV (SEQ ID NO:421) and CDR H3 comprises VRDRSNGSGKR-FESSNWFLDL (SEQ ID NO:441); and a light chain variable region, wherein CDR L1 comprises HNY, CDR L2 comprises DFN and CDR L3 comprises WAYDA (SEQ ID NO:419).

36. The anti-HIV antibody of claim 1, wherein the anti-HIV antibody comprises a heavy chain variable region, wherein CDR H1 comprises GFAFLDHI (SEQ ID NO:486), CDR H2 comprises VKTIGGVV (SEQ ID NO:481) and CDR H3 comprises SKAAAPDEAFPLEF (SEQ ID NO: 482); and a light chain variable region, wherein CDR L1 comprises NVD, CDR L2 comprises DNN and CDR L3 comprises SSTTF (SEQ ID NO: 479), wherein the antibody is not an antibody that consists of a heavy chain amino acid sequence of SEQ ID NO:59 and a light chain amino acid sequence of SEQ ID NO:60.

37. The anti-HIV antibody of claim 1, wherein the anti-HIV antibody comprises a heavy chain variable region, wherein CDR H1 comprises GFNFIDSV (SEQ ID NO:458), CDR H2 comprises IKPLRGGV (SEQ ID NO:490) and CDR H3 comprises AKGAFGGSSPFGF (SEQ ID NO: 491); and a light chain variable region, wherein CDR L2 comprises DVT and CDR L3 comprises ASFEF (SEQ ID NO:455), wherein the antibody is not an antibody that consists of a heavy chain amino acid sequence of SEQ ID NO: 71 and a light chain amino acid sequence of SEQ ID NO:72.

* * * * *